US008354262B2

(12) United States Patent
Novick et al.

(10) Patent No.: US 8,354,262 B2
(45) Date of Patent: Jan. 15, 2013

(54) CHEMICALLY MODIFIED CARBONIC ANHYDRASES USEFUL IN CARBON CAPTURE SYSTEMS

(75) Inventors: Scott Novick, Palo Alto, CA (US); Oscar Alvizo, Fremont, CA (US)

(73) Assignee: Codexis, Inc., Redwood City, CA (US)

(*) Notice: Subject to any disclaimer, the term of this patent is extended or adjusted under 35 U.S.C. 154(b) by 0 days.

(21) Appl. No.: 13/174,253

(22) Filed: Jun. 30, 2011

(65) Prior Publication Data
US 2012/0009646 A1 Jan. 12, 2012

Related U.S. Application Data

(60) Provisional application No. 61/360,040, filed on Jun. 30, 2010, provisional application No. 61/445,996, filed on Feb. 23, 2011, provisional application No. 61/492,758, filed on Jun. 2, 2011.

(51) Int. Cl.
C12N 9/96 (2006.01)
C02F 3/34 (2006.01)

(52) U.S. Cl. ........ 435/188; 435/197; 435/232; 435/262; 435/266

(58) Field of Classification Search ..................... None
See application file for complete search history.

(56) References Cited

U.S. PATENT DOCUMENTS

| | | | |
|---|---|---|---|
| 3,627,638 A | 12/1971 | Barker et al. |
| 3,666,733 A | 5/1972 | Epton |
| 3,702,804 A | 11/1972 | Barker et al. |
| 5,900,364 A | 5/1999 | Visuri |
| 6,143,556 A | 11/2000 | Trachtenberg |
| 6,475,382 B2 | 11/2002 | Parent |
| 6,524,843 B1 | 2/2003 | Blais et al. |
| 6,908,507 B2 | 6/2005 | LaLande et al. |
| 7,132,090 B2 | 11/2006 | Dziedzic et al. |
| 7,176,017 B2 | 2/2007 | Parent et al. |
| 7,267,971 B2 | 9/2007 | Thakur et al. |
| 7,514,056 B2 | 4/2009 | Fradette et al. |
| 7,521,217 B2 | 4/2009 | Daigle et al. |
| 7,579,185 B2 | 8/2009 | Parent et al. |
| 7,596,952 B2 | 10/2009 | Fradette et al. |
| 7,641,717 B2 | 1/2010 | Gal |
| 7,642,076 B2 | 1/2010 | Dziedzic et al. |
| 7,740,689 B2 | 6/2010 | Fradette et al. |
| 7,803,575 B2 | 9/2010 | Borchert et al. |
| 7,820,432 B2 | 10/2010 | Parent et al. |
| 7,862,788 B2 | 1/2011 | Gal et al. |
| 7,964,170 B2 | 6/2011 | Sing |
| 2004/0259231 A1 | 12/2004 | Bhattacharya |
| 2006/0048517 A1 | 3/2006 | Fradette et al. |
| 2006/0128004 A1 | 6/2006 | Anctil et al. |
| 2006/0213224 A1 | 9/2006 | Fradette et al. |
| 2006/0246564 A1 | 11/2006 | Parent et al. |
| 2006/0257990 A1 | 11/2006 | Daigle et al. |
| 2007/0004023 A1 | 1/2007 | Trachtenberg |
| 2007/0128713 A1 | 6/2007 | Parent et al. |
| 2007/0256559 A1 | 11/2007 | Chen et al. |
| 2008/0003662 A1 | 1/2008 | Trachtenberg |
| 2008/0148939 A1 | 6/2008 | Fradette et al. |
| 2008/0296231 A1 | 12/2008 | Schoevaart et al. |
| 2009/0148930 A1 | 6/2009 | Gal et al. |
| 2009/0155889 A1 | 6/2009 | Handagama et al. |
| 2009/0202409 A1 | 8/2009 | Smith et al. |
| 2009/0227010 A1 | 9/2009 | Daigle et al. |
| 2010/0011956 A1 | 1/2010 | Neumann et al. |
| 2010/0047866 A1 | 2/2010 | Borchert et al. |
| 2010/0068784 A1 | 3/2010 | Dziedzic et al. |
| 2010/0086983 A1 | 4/2010 | Gellett et al. |
| 2010/0196244 A1 | 8/2010 | Grauer et al. |
| 2010/0203619 A1 | 8/2010 | Fradette et al. |
| 2010/0209997 A1 | 8/2010 | Newman et al. |
| 2010/0236408 A1 | 9/2010 | Aspiron et al. |
| 2010/0294131 A1 | 11/2010 | Bade et al. |
| 2010/0297723 A1 | 11/2010 | Borchert et al. |
| 2010/0300894 A1 | 12/2010 | Lin et al. |
| 2011/0100216 A1 | 5/2011 | Kozak et al. |
| 2011/0100217 A1 | 5/2011 | Soloveichik et al. |

FOREIGN PATENT DOCUMENTS

| | | |
|---|---|---|
| EP | 1521629 B1 | 2/2007 |
| EP | 1627041 B1 | 11/2009 |
| EP | 2354098 A1 | 8/2011 |
| EP | 2354099 A1 | 8/2011 |
| GB | 1365886 | 9/1974 |
| WO | 9013635 A1 | 11/1990 |
| WO | 9105840 A1 | 5/1991 |
| WO | 9500171 A1 | 1/1995 |
| WO | 9640414 B1 | 12/1996 |
| WO | 9744445 A1 | 11/1997 |
| WO | 9955310 A1 | 11/1999 |
| WO | 0022157 A1 | 4/2000 |

(Continued)

OTHER PUBLICATIONS

Alber, B.E., et al., "A carbonic anhydrase from the archaeon Methlinsarcina thermophila", Proc. Natl. Acad. Sci. USA, 91:6909-6913, 1994.

Alber, B.E., et al., "Characterization of Heterologously Produced Carbonic Anhydrase from Methanosarcina thermophila", Journal of Bacteriology, 178(11):3270-3274, 1996.

Alber, B.E., et al., "Kinetic and Spectroscopic Characterization of the Gamma-Carbonic Anhydrase from the Methanoarchaeon Methanosarcina thermophila," Biochemistry, 38, 13119-13128, 1999.

(Continued)

Primary Examiner — Nashaat Nashed
(74) Attorney, Agent, or Firm — Codexis, Inc.

(57) ABSTRACT

The present disclosure relates to chemically modified carbonic anhydrase polypeptides and soluble compositions, homogenous liquid formulations comprising them. The chemically modified carbonic anhydrase polypeptides have improved properties relative to the same carbonic anhydrase polypeptide that is not chemically modified including the improved properties of increased activity and/or stability in the presence of amine compounds, ammonia, or carbonate ion. The present disclosure also provides methods of preparing the chemically modified polypeptides and methods of using the chemically modified polypeptides for accelerating the absorption of carbon dioxide from a gas stream into a solution as well as for the release of the absorbed carbon dioxide for further treatment and/or sequestering.

24 Claims, 1 Drawing Sheet

FOREIGN PATENT DOCUMENTS

| WO | 0190321 A2 | 11/2001 |
|---|---|---|
| WO | 0270646 A2 | 9/2002 |
| WO | 03066850 A1 | 8/2003 |
| WO | 2004028667 A1 | 7/2004 |
| WO | 2004056455 A1 | 7/2004 |
| WO | 2004081208 A1 | 9/2004 |
| WO | 2005066341 A1 | 7/2005 |
| WO | 2006022885 A1 | 3/2006 |
| WO | 2006089423 A1 | 8/2006 |
| WO | 2006108532 A1 | 10/2006 |
| WO | 2007036235 A1 | 4/2007 |
| WO | 2008008179 A2 | 1/2008 |
| WO | 2008041921 A1 | 4/2008 |
| WO | 2008072979 A1 | 6/2008 |
| WO | 2008095057 A2 | 8/2008 |
| WO | 2008099252 A1 | 8/2008 |
| WO | 2008110405 A2 | 9/2008 |
| WO | 2008/137846 A2 | 11/2008 |
| WO | 2009000025 A1 | 12/2008 |
| WO | 2009016642 A1 | 2/2009 |
| WO | 2009036145 A1 | 3/2009 |
| WO | 2009059104 A1 | 5/2009 |
| WO | 2009073422 A1 | 6/2009 |
| WO | 2009076327 A1 | 6/2009 |
| WO | 2009087060 A2 | 7/2009 |
| WO | 2009087210 A2 | 7/2009 |
| WO | 2009105419 A2 | 8/2009 |
| WO | 2009117550 A1 | 9/2009 |
| WO | 2010014773 A1 | 2/2010 |
| WO | 2010014774 A2 | 2/2010 |
| WO | 2010020017 A1 | 2/2010 |
| WO | 2010037109 A2 | 4/2010 |
| WO | 2010043459 A1 | 4/2010 |
| WO | 2010053683 A1 | 5/2010 |
| WO | 2010081007 A2 | 7/2010 |
| WO | 2010108974 A1 | 9/2010 |
| WO | 2010151787 A1 | 12/2010 |
| WO | 2011014955 A1 | 2/2011 |
| WO | 2011014956 A1 | 2/2011 |
| WO | 2011014957 A1 | 2/2011 |
| WO | 2011054107 A1 | 5/2011 |
| WO | 2011066304 A2 | 6/2011 |
| WO | 2011069857 A1 | 6/2011 |

OTHER PUBLICATIONS

Cowan, R.M., et al., "CO2 capture by means of an enzyme-based reactor", Ann. N.Y. Acad Sci., 984:453-469, 2003.
Darde, V., et al., "Chilled ammonia process for CO2 capture", International Journal of Greenhouse Gas Control, 4:131-136, 2010.
Elleuche, S., et al., "Evolution of carbonic anhydrases in fungi", Curr. Genet., 55:211-222, 2009.
Salmon, S., Holmes, J., Saunders, P. et al., "Ultrasound-assisted Regeneration for the CO2 Capture Processes," IPCOM00192838D, IP.COM Prior Art Database, 2010.
Iverson, T.M., et al., "A Closer Look at the Active Site of γ-Class Carbonic Anhydrases: High-Resolution Crystallographic Studies of the Carbonic Anhydrase from *Methanosarcina thermophila*", Biochemistry, 39:9222-9231, 2000.
Kisker, C., et al., "A left-handed β-helix revealed by the crystal structure of a carbonic anhydrase from the archaeon *Methanosarcina thermophila*", The EMBO Journal, 15(10):2323-2330, 1996.
Smith, K.S., et al., "A Plant-Type (β-Class) Carbonic Anhydrase in the Thermophilic Methanoarchaeon *Methanobacterium thermoautotrophicum*", Journal of Bacteriology, 181(20):6247-6253, 1999.
Smith, K.S., et al., "Carbonic anhydrase is an ancient enzyme widespread in prokaryotes", PNAS, 96 (26):15184-15189, 1999.
Trachtenberg, M.C., et al., "Carbon Dioxide Transport by Proteic and Facilitated Transport Membranes", Life Support & Biosphere Science, 6:293-302, 1999.
Tripp, B.C., et al., "A Structure-Function Study of a Proton Transport Pathway in the γ-Class Carbonic Anhydrase from *Methanosarcina thermophila*", Biochemistry, 39:9232-9240, 2000.
Tripp, B.C., et al., "Role of Arginine 59 in the γ-Class Carbonic Anhydrases", Biochemistry, 41:669-678, 2002.

Wilbur, K.M., et al., "Electrometric and Colorimetric Determination of Carbonic Anhydrase", The Journal of Biological Chemistry, pp. 147-154, 1948.
Zimmerman, S.A., "Understanding the Biochemistry and Physiology of Gamma Carbonic Anhydrases in *Methanosarcina thermophila*", The Pennsylvania State University, The Graduate School of Eberly College of Science, pp. 1-161, 2007.
Genbank Accession No. U08885, Birgit, E.A., "*Methanosarcina thermophila* TM-1 carbonic anhydrase gene, complete cds," 1994.
Genbank Accession No. YP_306494.1, Maeder, D. L. et al., Carbonic Anhydrase [*Methanosarcina barkeri* str. Fusaro], 2010.
Genbank Accession No. NP_635112.1, Deppenmeier, U. et al., Carbonic Anhydrase [*Methanosarcina mazei* Go1], 2010.
Genbank Accession No. NP_617439.1, Galagan, J.E., et al., Carbonate Dehydratase [*Methanosarcina acetivorans* C2A], 2010.
Bootorabi, F., et al., "Modification of carbonic anhydrase II with acetaldehyde, the first metabolite of ethanol, leads to decreased enzyme activity," BMC Biochemistry, vol. 9, No. 32, 2008.
Nagelhus, E., et al., Carbonic Anhydrase XIV is enriched in specific membrane domains of retinal pigment epithelium, Muller cells, and astrocytes, PNAS, vol. 102, No. 22, pp. 8030-8035, 2005.
Ulmasov, B. et al., "Purification and kinetic analysis of recombinant CA XII, a membrane carbonic anhydrase overexpressed in certain cancers," PNAS, vol. 97, No. 26. pp. 14212-14217, 2000.
Moya, A. et al. "Carbonic Anhydrase in the Scleractinian Coral *Stylophora pistillata*," Journ. Biol. Chem., vol. 283, No. 37, pp. 25475-25484, 2008.
Khodayari, A., "Experimental and Theoretical Study of Carbon Dioxide Absorption into Potassium Carbonate Solution Promoted with Enzyme," Thesis, University of Illinois, Urbana-Champaign, 2010.
Bhattacharya, S. et al., "CO2 hydration by immobilized carbonic anhydrase," Biotechnol. Appl. Biochem., 38,111-117, 2003.
Epton, R., "A Study of Carbonic Anhydrase Covalently bound to a Poly(acryloylmorpholine) Network in Aqueous/Organic Solvents," BiochemSocTrans., vol. 5, 274-276, 1977.
Epton, R., "Water-Soluble Coloured Covalent Conjugates of Carbonic Anhydrase and N-(sym-Trinitroaryl) polyacrylamide/Acrylhydrazide Co-Polymers," BiochemSocTrans., vol. 5, 277-279, 1977.
Epton, R., "Soluble polymer-protein conjugates: 1. Reactive N-(sym-trinitroaryl) polyacrylamide/acrylhydrazide copolymers and derived carbonic anhydrase conjugates," Polymer, vol. 18, 319-323, 1977.
Farmer, T., "Assessing the Multimeric States of Proteins: Studies Using Laser Desorption Mass Spectrometry," BiologicalMassSpectrometry, vol. 20, 796-800m 1991.
Gitlin, I., "Peracetylated Bovine Carbonic Anhydrase (BCA-Ac18) is Kinetically More Stable than Native BCA to Sodium Dodecyl Sulfate," J. Phys. Chem B. 110, 2372-2377, 2006.
Gudiksen, K., "Influence of teh Zn(II) Cofactor on the Refolding of Bovine Carbonic Anhydrase after Denaturation with Sodium Dodecyl Sulfate," Anal. Chem., vol. 76, No. 24, 7151-7161, 2004.
Gudiksen, K., "Eliminating Positively Charged Lysine eta-NH3+ Groups on the Surface of Carbonic Anhydrase Has No Significant Influence on Its Folding from Sodium Dodecyl Sulfate," J.Am.Chem. Soc.,127, 4707-4714, 2005.
Gudiksen, K., "Increasing the Net Charge and Decreasing the Hydrophobicity of Bovine Carbonic Anhydrase Decreases the Rate of Denaturation with Sodium Dodecyl Sulfate," Biophysical J., vol. 91, 298-310, 2006.
Hyyppa, M., "The Effects of Fixations on Carbonic Anhydrase Activity," Histochemie 12, 184-188, 1968.
Krishnamurthy, V., "Carbonic Anhydrase as a Model for Biophysical and Physical-Organic Studies of Proteins and Protein-Ligand Binding," Chem. Rev. 108, 946-1051, 2008.
Yang, J., "Synthesis of Monodisperse Polymers from Proteins," J. Am. Chem. Soc., 125, 12392-12393, 2003.
Kabadi, V.N., "Heat of Dissolution Measurements for CO2 in Mixed Alkanolamine Solvents," OSTI Final Technical Report, Oct. 8, 2007.
Genbank Accession No. YP_002436805 dated May 7, 2009.
Krebs, J, F., et al., "Determinants of Catalytic Activity and Stability of Carbonic Anhydrase II as Revealed by Random Mutagenesis," J. Biol. Chemistry, 268, 2, 948, 1993.

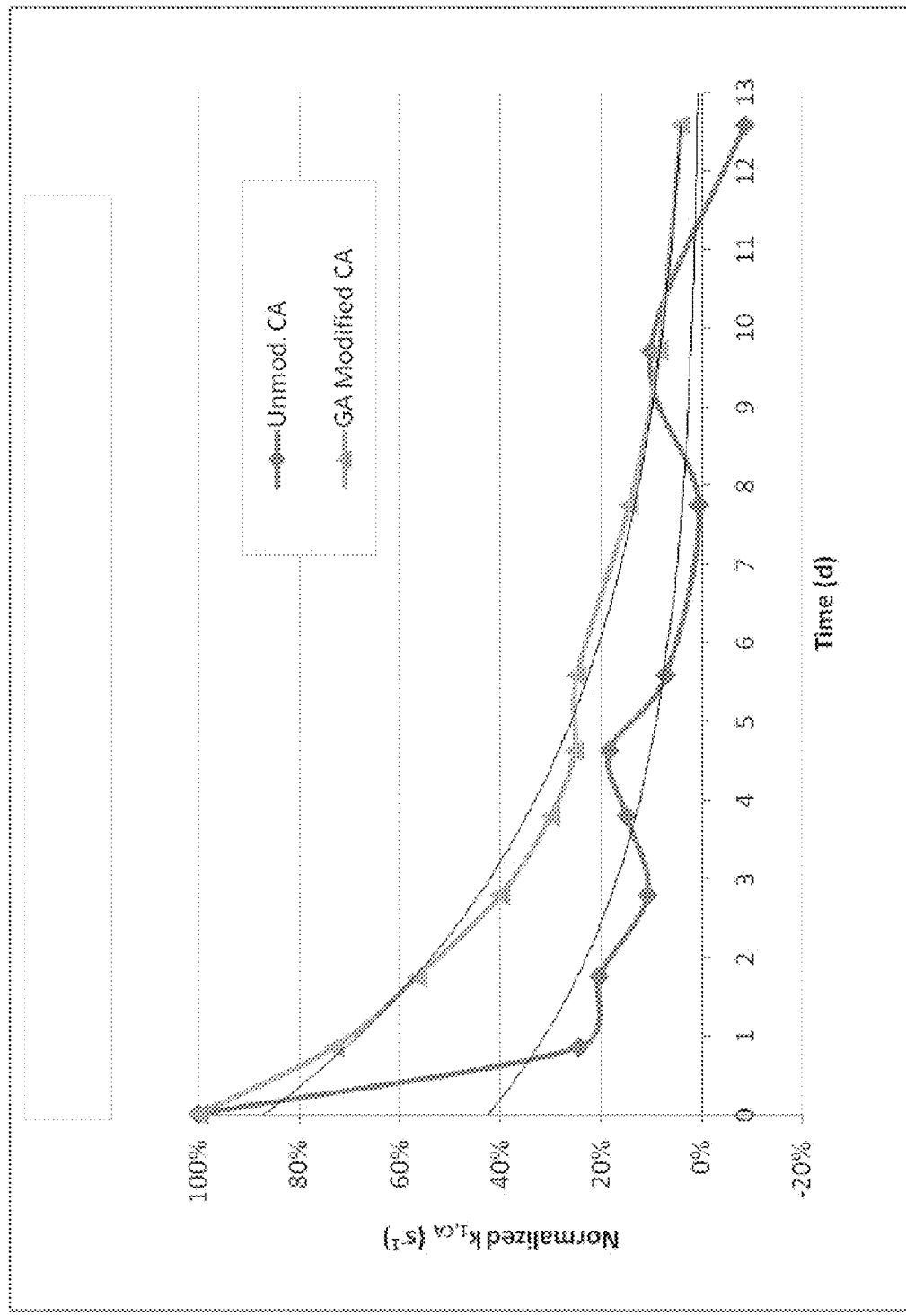

CHEMICALLY MODIFIED CARBONIC ANHYDRASES USEFUL IN CARBON CAPTURE SYSTEMS

1. CROSS REFERENCE TO RELATED APPLICATIONS

The present application claims priority of U.S. provisional patent applications 61/360,040, filed Jun. 30, 2010, 61/445,996, filed Feb. 23, 2011, and 61/492,758, filed Jun. 2, 2011, each of which is hereby incorporated by reference herein.

2. STATEMENT REGARDING FEDERALLY SPONSORED RESEARCH OR DEVELOPMENT

This invention was made with Government support under DE-AR0000071 awarded by the Department of Energy. The Government has certain rights in this invention.

3. TECHNICAL FIELD

The present disclosure relates to soluble compositions and formulations of chemically modified carbonic anhydrase polypeptides that exhibit increased activity and thermostability, and methods of using these polypeptides in carbon capture systems.

4. REFERENCE TO SEQUENCE LISTING, TABLE OR COMPUTER PROGRAM

The Sequence Listing concurrently submitted electronically under 37 C.F.R. §1.821 via EFS-Web in a computer readable form (CRF) as file name CX4-087US1_ST25.txt is herein incorporated by reference. The electronic copy of the Sequence Listing was created on Jun. 29, 2011 with a file size of 2,064,813 bytes.

5. BACKGROUND

The enzyme, carbonic anhydrase ("CA") (EC 4.2.1.1), catalyzes the reversible reactions depicted in Scheme 1:

Scheme 1

$$CO_2 + H_2O \xrightleftharpoons{CA} HCO_3^- + H^+$$

In the forward or "hydration" reaction, CA combines carbon dioxide and water to provide bicarbonate and a proton, or depending on the pH, to provide carbonate ($CO_3^{-2}$) and two protons. In the reverse, or "dehydration" reaction, CA combines bicarbonate and a proton to provide carbon dioxide and water. Carbonic anhydrases are metalloenzymes that typically have $Zn^{+2}$ in the active site. However carbonic anhydrases having e.g. $Co^{+2}$ or $Cd^{+2}$ in the active site have been reported. At least three classes of carbonic anhydrases have been identified in nature.

The α-class carbonic anhydrases are found in vertebrates, bacteria, algae, and the cytoplasm of green plants. Vertebrate α-class carbonic anhydrases are among the fastest enzymes known, exhibiting a turnover number ($k_{cat}$) (the number of molecules of substrate converted by an enzyme to product per catalytic site per unit of time) of $10^6$ $sec^{-1}$. The β-class carbonic anhydrases are found in bacteria, algae, and chloroplasts, while γ-class carbonic anhydrases are found in *Archaea* and some bacteria. Although carbonic anhydrases of each of these classes have similar active sites, they do not exhibit significant overall amino acid sequence homology and they are structurally distinguishable from one another. Hence, these three classes of carbonic anhydrase provide an example of convergent evolution.

It has been proposed to use carbonic anhydrase as a biological catalyst to accelerate the capture of carbon dioxide produced by combustion of fossil fuels. See e.g., U.S. Pat. Nos. 6,143,556, 6,524,843 B2, 7,176,017 B2, 7,596,952 B2, 7,579,185 B2, 7,740,689 B2, 7,132,090 B2; U.S. Pat. Publ. Nos. 2009/0155889A1, 2010/0086983A1; PCT Publ. Nos. WO2006/089423A1, WO2010/014773A1, WO2010/045689A1. Naturally occurring carbonic anhydrases, however, are not well-suited for use under the process relevant conditions that are required for an economically viable carbon dioxide capture system. These process relevant conditions include: presence in solution with high concentrations of other $CO_2$ absorption mediating compounds (e.g., amines, ammonia, carbonate ions, amino acids); elevated temperatures (e.g., 40° C. or above, or 15° C. or below in $NH_3$), alkaline pHs (e.g., pH 8-12); presence of gas contaminants (e.g., high levels $NO_x$ and $SO_x$); and extended periods of exposure to these challenging conditions (e.g., days to weeks). In addition, such carbonic anhydrases should also be stable to variations in these process conditions, e.g., stable not only at a relatively alkaline pH suitable for hydration and sequestration of carbon dioxide but also at a relatively acidic pH suitable for subsequent release and/or recapture of the hydrated and/or sequestered carbon dioxide.

Chemical conjugates of α-class carbonic anhydrases and some of their physical properties have been described in the following references: Epton et al. "Soluble polymer-protein conjugates: 1. Reactive N-(sym-trinitroaryl)polyacrylamide/acrylhydrazide copolymers and derived carbonic anhydrase conjugates," Polymer 18: 319-323 (1977); Farmer et al., "Assessing the Multimeric States of Proteins: Studies Using Laser Desorption Mass Spectrometry," Biol. Mass Spectrometry 20, 796-800 (1991); Gitlin et al., "Peracetylated Bovine Carbonic Anhydrase ($BCA-Ac_{18}$) Is Kinetically More Stable than Native BCA to Sodium Dodecyl Sulfate," J. Phys. Chem. B. 110: 2372-2377 (2006); Gudiksen et al., "Eliminating Positively Charged Lysine e-$NH_3^+$ Groups on the Surface of Carbonic Anhydrase Has No Significant Influence on Its Folding from Sodium Dodecyl Sulfate," J. Am. Chem. Soc. 127: 4707-4714 (2005); Gudiksen et al., "Increasing the Net Charge and Decreasing the Hydrophobicity of Bovine Carbonic Anhydrase Decreases the Rate of Denaturation with Sodium Dodecyl Sulfate," Biophys. J. 91: 298-310 (2006); Bootorabi et al., "Modification of carbonic anhydrase II with acetaldehyde, the first metabolite of ethanol, leads to decreased enzyme activity," BMC Biochemistry 9: 32 (2008); Trachtenberg et al., "Carbon Dioxide Transport By Proteic And Facilitated Transport Membranes," Life Support & Biosphere Science 6: 293-302 (1999); and Bhattacharya et al., "$CO_2$ hydration by immobilized carbonic anhydrase," Biotechnol. Appl. Biochem. 38: 111-117 (2003).

Accordingly, there is a need in the art for engineered and/or chemically modified carbonic anhydrases with further improved enzymatic properties that can effectively accelerate the absorption of carbon dioxide from a gas stream and/or accelerate desorption of carbon dioxide from a capture solution under process relevant conditions.

6. SUMMARY

The present disclosure provides soluble compositions and homogenous liquid formulations comprising a carbonic anhydrase that is chemically modified by treatment with a cross-linking agent. The chemically modified carbonic anhydrases of the present disclosure are not cross-linked or otherwise attached to a solid phase. The soluble compositions of the present disclosure are soluble in aqueous solvent, forming a homogenous liquid solution. For example, in one embodiment, the present disclosure provides a soluble composition having carbonic anhydrase activity comprising a carbonic anhydrase polypeptide chemically modified by treatment with a cross-linking agent, wherein the polypeptide amino acid sequence has at least 80% identity to SEQ ID NO:2. Similarly, the formulations of the present disclosure, which comprise a chemically modified carbonic anhydrase, a $CO_2$ absorption mediating compound, and an aqueous solvent, are also homogenous liquid solutions. For example, the homogenous liquid formulation can comprise an aqueous solution of the soluble composition of any of the chemically modified carbonic anhydrase polypeptides disclosed herein and a $CO_2$ absorption mediating compound.

A surprising advantage of the chemically modified carbonic anhydrases of the present disclosure (and the soluble compositions and formulations comprising them) is that they have increased stability and/or increased carbonic anhydrase activity (e.g., at least 1.5-fold, at least 2-fold, at least 4-fold, or even at least 5-fold increased) relative to the same carbonic anhydrase that is not chemically modified under process relevant carbon capture conditions (e.g., high temperature and the presence of high concentrations of $CO_2$ absorption mediating compounds). More specifically, the chemically modified carbonic anhydrases of the present disclosure are capable of improved acceleration (relative to the same carbonic anhydrase that is not chemically modified) of the absorption of carbon dioxide from a gas stream into a solution comprising a $CO_2$ absorption mediating compound (e g., amines, ammonia, carbonate ion, amino acid) under suitable conditions useful for various carbon capture processes (e.g., flue-gas scrubbers). Thus, in various embodiments the present disclosure provides chemically modified carbonic anhydrase polypeptides, and compositions and formulations comprising them, that are capable of catalyzing the hydration of carbon dioxide to bicarbonate or the reverse dehydration of bicarbonate to carbon dioxide with increased activity relative to the same carbonic anhydrases that are not chemically modified (and other known naturally occurring carbonic anhydrases) after exposure to high concentrations of $CO_2$ absorption mediating compound and/or thermal (e.g., T>40° C.). For example, in some embodiments, the chemically modified carbonic anhydrases have carbonic anhydrase activity in 4.2 M MDEA at 50° C. that is increased (e.g., at least 1.5-fold, at least 2-fold, at least 4-fold, or even at least 5-fold increased) relative to the activity of the same carbonic anhydrase polypeptide that is not chemically modified (i.e., unmodified). Similarly, in some embodiments, the chemically modified carbonic anhydrase is characterized by stability in 4.2 M MDEA at 75° C. that is increased (e.g., at least 1.5-fold, at least 2-fold, at least 4-fold, or even at least 5-fold increased) relative to the carbonic anhydrase polypeptide when it is not chemically modified.

Accordingly, the present disclosure also provides methods, processes, and bioreactors for using the disclosed chemically modified carbonic anhydrases polypeptides, compositions, and formulations for carbon capture. In some embodiments, the chemically modified carbonic anhydrase polypeptides (and compositions and formulations comprising them) of the present disclosure are used in methods for removing carbon dioxide from a gas stream, e.g., flue gas produced by the combustion of fossil fuels. The methods for removing carbon dioxide from a gas stream (e.g., capturing or extracting $CO_2$ gas) comprise the step of contacting the gas stream with a solution, wherein comprises a chemically modified carbonic anhydrase polypeptide of the disclosure having an improved property (e.g., increased activity, thermostability and/or solvent stability), whereby carbon dioxide from the gas stream is absorbed into the solution (e.g., $CO_2$ gas diffuses into solution and is hydrated to bicarbonate). In some embodiments, the present disclosure provides a method for removing carbon dioxide from a gas stream comprising the step of contacting the gas stream with a homogenous liquid solution under suitable conditions, wherein the solution comprises: (i) a carbonic anhydrase polypeptide chemically modified by treatment with a cross-linking agent; and (ii) a $CO_2$ absorption mediating compound; whereby the solution absorbs at least a portion of the carbon dioxide from the gas stream. The method can comprise further steps of isolating and/or separately treating the solution comprising the absorbed carbon dioxide according to known methods to further sequester and/or otherwise utilize the carbon dioxide. The methods of removing carbon dioxide from a gas stream using a chemically modified carbonic anhydrase polypeptide disclosed herein can be carried out in the presence of a range of $CO_2$ absorption mediating compounds, and under a range of suitable conditions disclosed herein including, but not limited to: polypeptide concentration (and polypeptide form—e.g., lysates, whole cells, or purified powder); solution temperature; solution pH; solution $CO_2$ loading (e.g., $\alpha=0$ to about 0.7); solvent composition; solution concentration of specified $CO_2$ absorption mediating compound—e.g., an amine compound, ammonia, and/or carbonate ion.

The present disclosure also provides methods, reagents, and conditions for preparing the chemically modified carbonic anhydrases polypeptides having the improved properties of increased activity and/or stability that make them particularly useful in the carbon capture methods, processes and bioreactors. In some embodiments, the disclosure provides a method comprising contacting a solution of a carbonic anhydrase polypeptide (e.g., an α-class, β-class, γ-class, ζ-class (zeta-class), and/or recombinant or engineered carbonic anhydrase) with a solution of a cross-linking agent selected from the group consisting of a dialdehyde, a bis-imidate ester, a bis(N-hydroxysuccinimide)ester, a diacid chloride, and mixtures thereof.

The present disclosure provides a variety of carbonic anhydrase polypeptides and cross-linking agents useful for preparation and use of the chemically modified carbonic anhydrase polypeptides, compositions, and formulations exhibiting improved properties under carbon capture process conditions. The various cross-linking agents provided are selected from the group consisting of dialdehyde, a bis-imidate ester, a bis(N-hydroxysuccinimide)ester, a diacid chloride, and mixtures thereof and can include any one of the cross-linking agents: malondialdehyde, glutaraldehyde, dimethyl suberimidate, dimethyl pimelimidate, suberic acid bis(N-hydroxysuccinimide), and mixtures thereof.

In some embodiments, the carbonic anhydrase polypeptide that is chemically modified by treatment with a cross-linking agent is a naturally-occurring α-class, β-class, γ-class, or ζ-class (zeta-class) carbonic anhydrase, or a recombinant carbonic anhydrase derived therefrom. In some embodiments, the carbonic anhydrase is an α-class carbonic anhydrase comprising an amino acid sequence selected from the group consisting of SEQ ID NO: 1298, 1300, 1302, 1304, 1306, and 1308, or a recombinant carbonic anhydrase derived therefrom. In some embodiments, the carbonic anhydrase that is chemically modified is a β-class carbonic anhydrase comprising an amino acid sequence selected from the group consisting of SEQ ID NO: 2, 1288, 1290, 1292, 1294, and 1296, or a recombinant carbonic anhydrase derived therefrom. In some embodiments, the carbonic anhydrase that is chemically modified is a recombinant or engineered carbonic anhydrase polypeptide that has improved enzymatic properties relative to a reference polypeptide—e.g., a naturally occurring carbonic anhydrase from which the engineered carbonic anhydrase was derived. Thus, the improved enzymatic properties associated with the engineered carbonic anhydrase can be further improved by chemical modification as described in the present disclosure. Accordingly, in one aspect, the chemically modified carbonic anhydrase polypeptides described herein can also have an amino acid sequence that has one or more amino acid differences as compared to a wild-type carbonic anhydrase or an engineered carbonic anhydrase that result in an improved property of the enzyme. Exemplary recombinant or engineered carbonic anhydrase polypeptides having an improved enzyme property can comprise an amino acid sequence selected from the polypeptide amino acid sequences summarized in Tables 2A, 2B, 2C, 2D, 2E, 2F, 2G, 2H, 2I, and 2J, and disclosed in the accompanying Sequence Listing, specifically any one or more of the polypeptide amino acid sequences selected from the group consisting of the even-numbered sequence identifiers of SEQ ID NO: 4-1286.

Improvements of the chemically modified carbonic anhydrase polypeptides associated with the chemical modification by treatment with a cross-linking agent as disclosed herein can include increased carbonic anhydrase activity, and/or increased solvent or thermal stability of the carbonic anhydrase in the presence of compounds that mediate the absorption or sequestration of carbon dioxide, including, for example, ammonia, carbonate ions, or amine compounds (e.g., monoethanolamine (MEA), methyldiethanolamine (MDEA), 2-aminomethylpropanolamine (AMP), 2-(2-aminoethylamino)ethanol (AEE), triethanolamine (TEA), 2-amino-2-hydroxymethyl-1,3-propanediol (AHPD), piperazine, piperidine, mono- and diethanolamine). Accordingly, in some embodiments, the chemically modified carbonic anhydrase polypeptides, compositions and formulations comprising them, and methods of using them are characterized by at least 1.5-fold, at least 2-fold, at least 4-fold, or at least 5-fold increased carbonic anhydrase activity relative to the carbonic anhydrase polypeptide when it is not chemically modified, for example, when the activity is measured in 4.2 M MDEA at 50° C., or is measured in 2 M ammonia at 20° C. In some embodiments, the chemically modified carbonic anhydrase polypeptides (and compositions and formulations comprising them) are characterized by at least 1.5-fold, at least 2-fold, at least 4-fold, or at least 5-fold increased stability relative to the carbonic anhydrase polypeptide when it is not chemically modified, for example, when the stability is measured as residual carbonic anhydrase activity following 24 hours exposure to 4.2 M MDEA at 75° C.

The present disclosure also provides methods for preparing the chemically modified carbonic anhydrase polypeptides having improved properties relative to unmodified carbonic anhydrase polypeptides. In some embodiments of the method for preparing the chemically modified carbonic anhydrase polypeptides, the method comprising contacting in a solution: (i) a carbonic anhydrase polypeptide, wherein the polypeptide comprises an amino acid sequence having at least 80% identity to SEQ ID NO:2; and (ii) a cross-linking agent selected from the group consisting of a dialdehyde, a bis-imidate ester, a bis(N-hydroxysuccinimide)ester, a diacid chloride, and mixtures thereof. The various cross-linking agents provided used in the method of preparing can include any one of the cross-linking agents: malondialdehyde, glutaraldehyde, dimethyl suberimidate, dimethyl pimelimidate, suberic acid bis(N-hydroxysuccinimide), or mixtures thereof. In embodiments of the method for preparing, the cross-linking agent is at a concentration of from about 0.05% to about 10%, from about 0.1% to about 5%, or from about 0.25% to about 2.5%, or at least about 0.05%, at least about 0.1%, at least about 0.25%, at least about 0.5%, at least about 1%, at least about 2%, or at least about 2.5%. In some embodiments of the method for preparing, the solution has a concentration of carbonic anhydrase polypeptide of from about 1 g/L to about 150 g/L, from about 10 g/L to about 100 g/L, from about 25 g/L to about 100 g/L, or at least about 1 g/L, at least about 5 g/L, at least about 10 g/L, at least about 25 g/L, at least about 50 g/L, at least about 75 g/L, or at least about 100 g/L.

7. BRIEF DESCRIPTION OF THE DRAWINGS

FIG. 1 depicts plots of normalized carbonic anhydrase activity, $k_{1,CA}$ ($s^{-1}$) for a 1 g/L solution of a recombinant β-class carbonic anhydrase polypeptide of SEQ ID NO: 1152 that has been chemically modified by treatment with 0.25% glutaraldehyde ("GA modified CA") and the same recombinant carbonic anhydrase polypeptide at 1 g/L that has not been chemically modified ("Unmod. CA"), both versus days of challenge by incubation in assay solution at 75° C. Assay was carried out in 4.2 M MDEA solution, unloaded with $CO_2$ at 50° C.

8. DETAILED DESCRIPTION

The present disclosure is directed to carbonic anhydrase polypeptides that are chemically modified by treatment with a cross-linking agent and that have improved properties, particularly improved carbonic anhydrase activity and/or stability as compared to the same carbonic anhydrase polypeptides that have not been chemically modified. The present disclosure also is directed to soluble compositions comprising these chemically modified carbonic anhydrase polypeptides, and homogenous liquid formulations of these chemically modified carbonic anhydrase polypeptides and $CO_2$ absorption mediating compounds. The present disclosure provides the chemically modified polypeptides, and methods of preparing these chemically modified polypeptides (and associated compositions and formulations) by treatment of unmodified naturally occurring α-class, β-class, γ-class, or ζ-class carbonic anhydrase polypeptides, or recombinant carbonic anhydrase polypeptides derived therefrom (which can include amino acid differences relative to a wild-type sequence) with any of a variety of cross-linking agents (e.g., malondialdehyde, glutaraldehyde, dimethyl suberimidate, dimethyl pimelimidate, suberic acid bis(N-hydroxysuccinimide)).

The present disclosure also provides methods for using such chemically modified carbonic anhydrase polypeptides, compositions, and formulations, in processes for the capture and sequestration of carbon dioxide e.g., generated by combustion of fossil fuel. The methods disclosed include the use of the chemically modified carbonic anhydrase polypeptides in combination with various $CO_2$ absorption mediating compounds (including amines, ammonia, carbonate ions), and under various reaction conditions including conditions comprising high concentrations of the $CO_2$ absorption mediating compounds including amines, ammonia, carbonate ions, and/or temperatures that are significantly increased or decreased relative to ambient temperatures.

8.1. Definitions

The technical and scientific terms used in the descriptions herein will have the meanings commonly understood by one of ordinary skill in the art, unless specifically defined otherwise. Accordingly, the following terms are intended to have the following meanings.

"Carbonic anhydrase" and "CA" are used interchangeably herein to refer to a polypeptide having an enzymatic capability of carrying out the reactions depicted in Scheme 1. Carbonic anhydrase as used herein include naturally occurring (wild-type) carbonic anhydrases as well as non-naturally occurring, engineered, or recombinant carbonic anhydrase polypeptides generated by human manipulation.

"Protein", "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

"Naturally occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

"Recombinant" or "engineered" or "non-naturally occurring" when used with reference to, e.g., a cell, nucleic acid, or polypeptide, refers to a material, or a material corresponding to the natural or native form of the material, that has been modified in a manner that would not otherwise exist in nature, or is identical thereto but produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

"Percentage of sequence identity," "percent identity," and "percent identical" are used herein to refer to comparisons between polynucleotide sequences or polypeptide sequences, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage is calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Determination of optimal alignment and percent sequence identity is performed using the BLAST and BLAST 2.0 algorithms (see e.g., Altschul et al., 1990, J. Mol. Biol. 215: 403-410 and Altschul et al., 1977, Nucleic Acids Res. 3389-3402). Software for performing BLAST analyses is publicly available through the National Center for Biotechnology Information website.

Briefly, the BLAST analyses involve first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, $M=5$, $N=-4$, and a comparison of both strands. For amino acid sequences, the BLASTP program uses as defaults a wordlength (W) of 3, an expectation (E) of 10, and the BLOSUM62 scoring matrix (see Henikoff and Henikoff, 1989, Proc Natl Acad Sci USA 89:10915).

Numerous other algorithms are available that function similarly to BLAST in providing percent identity for two sequences. Optimal alignment of sequences for comparison can be conducted, e.g., by the local homology algorithm of Smith and Waterman, 1981, Adv. Appl. Math. 2:482, by the homology alignment algorithm of Needleman and Wunsch, 1970, J. Mol. Biol. 48:443, by the search for similarity method of Pearson and Lipman, 1988, Proc. Natl. Acad. Sci. USA 85:2444, by computerized implementations of these algorithms (GAP, BESTFIT, FASTA, and TFASTA in the GCG Wisconsin Software Package), or by visual inspection (see generally, Current Protocols in Molecular Biology, F. M. Ausubel et al., eds., Current Protocols, a joint venture between Greene Publishing Associates, Inc. and John Wiley & Sons, Inc., (1995 Supplement) (Ausubel)). Additionally, determination of sequence alignment and percent sequence identity can employ the BESTFIT or GAP programs in the GCG Wisconsin Software package (Accelrys, Madison Wis.), using default parameters provided.

"Reference sequence" refers to a defined sequence to which another sequence is compared. A reference sequence is not limited to wild-type sequences, and can include engineered or altered sequences. For example, a reference sequence can be a previously engineered or altered amino acid sequence. A reference sequence also may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides over a comparison window to identify and compare local regions of sequence similarity.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered carbonic anhydrase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Different from" or "differs from" with respect to a designated reference sequence refers to difference of a given amino acid or polynucleotide sequence when aligned to the reference sequence. Generally, the differences can be determined when the two sequences are optimally aligned. Differences include insertions, deletions, or substitutions of amino acid residues in comparison to the reference sequence.

"Derived from" as used herein in the context of engineered carbonic anhydrase enzymes, identifies the originating carbonic anhydrase enzyme, and/or the gene encoding such carbonic anhydrase enzyme, upon which the engineering was based.

"Amino acid residue" or "amino acid" or "residue" as used herein refers to the specific monomer at a sequence position of a polypeptide (e.g., D7 indicates that the "amino acid" or "residue" at position 7 of SEQ ID NO: 2 is an aspartic acid (D).)

"Amino acid difference" or "residue difference" refers to a change in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X3 as compared to SEQ ID NO: 2" refers to a change of the amino acid residue at the polypeptide position corresponding to position 3 of SEQ ID NO:2. Thus, if the reference polypeptide of SEQ ID NO: 2 has a glutamine at position 3, then a "residue difference at position X3 as compared to SEQ ID NO:2" an amino acid substitution of any residue other than glutamine at the position of the polypeptide corresponding to position 3 of SEQ ID NO: 2. In most instances herein, the specific amino acid residue difference at a position is indicated as "XnY" where "Xn" specifies the corresponding position as described above, and "Y" is the single letter identifier of the amino acid found in the engineered polypeptide (i.e., the different residue than in the reference polypeptide). In some instances, the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. For example, "D7S" would refer to the substitution of the amino acid residue, aspartic acid (D) at position 7 of reference sequence with the amino acid serine (S). In some instances, a polypeptide of the present disclosure can include one or more amino acid residue differences relative to a reference sequence, which is indicated by a list of the specified positions where changes are made relative to the reference sequence. The present disclosure includes engineered polypeptide sequences comprising one or more amino acid differences that include either/or both conservative and non-conservative amino acid substitutions.

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid, e.g., alanine, valine, leucine, and isoleucine; an amino acid with hydroxyl side chain is substituted with another amino acid with a hydroxyl side chain, e.g., serine and threonine; an amino acids having aromatic side chains is substituted with another amino acid having an aromatic side chain, e.g., phenylalanine, tyrosine, tryptophan, and histidine; an amino acid with a basic side chain is substituted with another amino acid with a basis side chain, e.g., lysine and arginine; an amino acid with an acidic side chain is substituted with another amino acid with an acidic side chain, e.g., aspartic acid or glutamic acid; and a hydrophobic or hydrophilic amino acid is replaced with another hydrophobic or hydrophilic amino acid, respectively. Exemplary conservative substitutions are provided in Table 1.

TABLE 1

| Residue | Possible Conservative Substitutions |
|---|---|
| A, L, V, I | Other aliphatic (A, L, V, I) |
|  | Other non-polar (A, L, V, I, G, M) |
| G, M | Other non-polar (A, L, V, I, G, M) |
| D, E | Other acidic (D, E) |
| K, R | Other basic (K, R) |
| N, Q, S, T | Other polar |
| H, Y, W, F | Other aromatic (H, Y, W, F) |
| C, P | None |

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification of the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the polypeptide while retaining enzymatic activity and/or retaining the improved properties of an engineered carbonic anhydrase enzyme. Deletions can be directed to the internal portions and/or terminal portions of the polypeptide. In various embodiments, the deletion can comprise a continuous segment or can be discontinuous.

"Insertion" refers to modification of the polypeptide by addition of one or more amino acids to the reference polypeptide. In some embodiments, the improved engineered carbonic anhydrase enzymes comprise insertions of one or more amino acids to the naturally occurring carbonic anhydrase polypeptide as well as insertions of one or more amino acids to other improved carbonic anhydrase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

"Fragment" as used herein refers to a polypeptide that has an amino-terminal and/or carboxy-terminal deletion, but where the remaining amino acid sequence is identical to the corresponding positions in the sequence. Fragments can typically have about 80%, 90%, 95%, 98%, and 99% of the full-length carbonic anhydrase polypeptide, for example the polypeptide of SEQ ID NO:2. The amino acid sequences of the specific recombinant carbonic anhydrase polypeptides included in the Sequence Listing of the present disclosure include an initiating methionine (M) residue (i.e., M represents residue position 1). The skilled artisan, however, understands that this initiating methionine residue can be removed by biological processing machinery, such as in a host cell or in vitro translation system, to generate a mature protein lacking the initiating methionine residue, but otherwise retaining the enzyme's properties. Consequently, the term "amino acid residue difference relative to SEQ ID NO: 2 at position Xn" as used herein may refer to position "Xn" or to the corresponding position (e.g., position (X-1)n) in a reference sequence that has been processed so as to lack the starting methionine.

"Improved enzyme property" or "improved property" as used herein refers to a functional characteristic of an enzyme that is improved relative to the same functional characteristic of a reference enzyme. Improved enzyme properties of the engineered carbonic anhydrase polypeptides disclosed herein can include but are not limited to: increased thermostability, increased solvent stability, increased pH stability, altered pH activity profile, increased activity (including increased rate conversion of substrate to product, or increased percentage conversion in a period of time), increased and/or altered stereoselectivity, altered substrate specificity and/or preference, decreased substrate, product, and side-product inhibition (e.g., $CO_2$, carbonate, bicarbonate, carbamate, or solvent-adducts thereof), decreased inhibition by a component of the feedstock (e.g. exhaust, flue gas components such as $NO_x$ and $SO_x$ compounds, etc.), decreased side-product or impurity production, altered cofactor preference, increased expression, increased secretion, as well as increased stability and/or activity in the presence of additional compounds reagents useful for absorption or sequestration of carbon dioxide, including, for example, amine solvents such as monoethanolamine, methyldiethanolamine, and 2-aminomethylpropanolamine.

"Stability in the presence of" as used in the context of improved enzyme properties disclosed herein refers to stability of the enzyme measured during or after exposure of the enzyme to certain compounds/reagents/ions (e.g., amine compound, ammonia, and/or carbonate ions) in the same solution with the enzyme. It is intended to encompass challenge assays of stability where the enzyme is first exposed to the amine compound or ammonia for some period of time then assayed in a solution under different conditions.

"Solution" as used herein refers to any medium, phase, or mixture of phases, in which the carbonic anhydrase polypeptide is active. It is intended to include purely liquid phase solutions (e.g., aqueous, or aqueous mixtures with co-solvents, including emulsions and separated liquid phases), as well as slurries and other forms of solutions having mixed liquid-solid phases.

"Homogenous liquid solution" as used herein refers to a formulation that is uniformly liquid (e.g., a liquid that does not include a suspended solid phase).

"Soluble composition" as used herein refers to a composition capable of dissolving to form a homogenous liquid solution in an aqueous solvent.

"Thermostability" refers to the functional characteristic of retaining activity (e.g., more than 60% to 80%) in the presence of, or after exposure to for a period of time (e.g. 0.5-24 hrs), elevated temperatures (e.g. 30-100° C.) compared to the activity of an untreated enzyme.

"Solvent stability" refers to the functional characteristic of retaining activity (e.g., more than 60% to 80%) in the presence of, or after exposure to for a period of time (e.g. 0.5-24 hrs), increased concentrations (e.g., 5-99%) of solvent compared to the activity of an untreated enzyme.

"pH stability" refers to the functional characteristic of retaining activity (e.g., more than 60% to 80%) in the presence of, or after exposure to for a period of time (e.g. 0.5-24 hrs), conditions of high or low pH (e.g., pH 9 to 12) compared to the activity of an untreated enzyme.

"Increased enzymatic activity" or "increased activity" refers to an improved property of the engineered enzyme (e.g., carbonic anhydrase), which can be represented by an increase in specific activity (e.g., product produced/time/weight protein) or an increase in percent conversion of the substrate to the product (e.g., percent conversion of carbon dioxide to bicarbonate and/or carbonate in a specified time period using a specified amount of carbonic anhydrase) as compared to a reference enzyme under suitable reaction conditions. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1-times the enzymatic activity of the corresponding wild-type carbonic anhydrase enzyme, to as much as 1.2-times, 1.5-times, 2-times, 3-times, 4-times, 5-times, 6-times, 7-times, or more than 8-times the enzymatic activity than the naturally occurring parent carbonic anhydrase. It is understood by the skilled artisan that the activity of any enzyme is diffusion limited such that the catalytic turnover rate cannot exceed the diffusion rate of the substrate, including any required cofactors. The theoretical maximum of the diffusion limit, or $k_{cat}/K_m$, is generally about $10^8$ to $10^9$ ($M^{-1} s^{-1}$). Hence, any improvements in the enzyme activity of the carbonic anhydrase will have an upper limit related to the diffusion rate of the substrates acted on by the carbonic anhydrase enzyme. Carbonic anhydrase activity can be measured by any one of standard assays used for measuring carbonic anhydrase, e.g., as provided in the Examples. Comparisons of enzyme activities are made, e.g., using a defined preparation of enzyme, a defined assay under a set of conditions, as further described in detail herein. Generally, when lysates are compared, the numbers of cells and the amount of protein assayed are determined as well as use of identical expression systems and identical host cells to minimize variations in amount of enzyme produced by the host cells and present in the lysates.

"Conversion" refers to the enzymatic conversion of the substrate to the corresponding product. "Percent conversion" refers to the percent of the substrate that is reduced to the product within a period of time under specified conditions. Thus, the "enzymatic activity" or "activity" of a carbonic anhydrase polypeptide can be expressed as "percent conversion" of the substrate to the product.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The improved carbonic anhydrase enzymes may be present within a cell, present in the cellular medium, or prepared in various forms, such as lysates or isolated preparations. As such, in some embodiments, the improved carbonic anhydrase enzyme can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure carbonic anhydrase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated improved carbonic anhydrase polypeptide is a substantially pure polypeptide composition.

"Coding sequence" refers to that portion of a polynucleotide that encodes an amino acid sequence of a protein (e.g., a gene).

"Heterologous" polynucleotide refers to any polynucleotide that is introduced into a host cell by laboratory techniques, and includes polynucleotides that are removed from a host cell, subjected to laboratory manipulation, and then reintroduced into a host cell.

"Codon optimized" refers to changes in the codons of the polynucleotide encoding a protein to those preferentially used in a particular organism such that the encoded protein is efficiently expressed in the organism of interest. In some embodiments, the polynucleotides encoding the carbonic anhydrase enzymes may be codon optimized for optimal production from the host organism selected for expression.

"Control sequence" is defined herein to include all components, which are necessary or advantageous for the expression of a polynucleotide and/or polypeptide of the present disclosure. Each control sequence may be native or foreign to the polynucleotide of interest. Such control sequences include, but are not limited to, a leader, polyadenylation sequence, propeptide sequence, promoter, signal peptide sequence, and transcription terminator.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Cross-linking agent" as used herein refers to a compound or a mixture of compounds that causes or forms covalent or ionic bonds linking amino acid residues of one or more polypeptide molecules.

"Chemically modified polypeptide" as used herein in the context of "chemically modified carbonic anhydrase polypeptide" refers to a polypeptide molecule having one or more amino acid residues which have formed covalent or ionic bonds with a compound (e.g., a cross-linking agent such as glutaraldehyde).

"$CO_2$ absorption mediating compound" as used herein refers to a compound that increases the ability (e.g., kinetic and/or thermodynamic) of a solution in which it is present to absorb $CO_2$ gas. $CO_2$ absorption mediating compounds can include ammonia, carbonate salts, amino acids, and amine compounds, including but not limited to: 2-(2-aminoethylamino)ethanol (AEE), 2-amino-2-hydroxymethyl-1,3-propanediol (AHPD), 2-amino-2-methyl-1-propanol (AMP), diethanolamine (DEA), diisopropanolamine (DIPA), N-hydroxyethylpiperazine (HEP), N-methyldiethanolamine (MDEA), monoethanolamine (MEA), N-methylpiperazine (MP), piperazine, piperidine, 2-(2-tert-butylaminoethoxy) ethanol (TBEE), triethanolamine (TEA), triisopropanolamine (TIA), tris, 2-(2-aminoethoxy)ethanol, 2-(2-tert-butylaminopropoxy)ethanol, 2-(2-tert-amylaminoethoxy) ethanol, 2-(2-isopropylaminopropoxy)ethanol, and 2-(2-(1-methyl-1-ethylpropylamino)ethoxy)ethanol.

8.2. Chemically Modified Carbonic Anhydrase Polypeptides

The present disclosure provides carbonic anhydrase polypeptides that are chemically modified by treatment with a cross-linking agent. The disclosure also provides soluble compositions and homogenous liquid formulations comprising these chemically modified carbonic anhydrase polypeptides. These chemically modified carbonic anhydrases are not cross-linked or otherwise attached to a solid phase. The soluble compositions comprising them are soluble in aqueous solvent, forming a homogenous liquid solution. For example, in one embodiment, the present disclosure provides a soluble composition having carbonic anhydrase activity comprising a carbonic anhydrase polypeptide chemically modified by treatment with a cross-linking agent, wherein the polypeptide amino acid sequence has at least 80% identity to SEQ ID NO:2. Similarly, the present disclosure provides formulations comprising the chemically modified carbonic anhydrases, together with a $CO_2$ absorption mediating compound, and an aqueous solvent. These formulations are also homogenous liquid solutions. For example, these homogenous liquid formulations can comprise an aqueous solution of the soluble composition of any of the chemically modified carbonic anhydrase polypeptides disclosed herein and a $CO_2$ absorption mediating compound selected from ammonia, an amine compound, or carbonate ion.

A surprising advantage of these soluble compositions and homogenous liquid formulations comprising chemically modified carbonic anhydrases is that they have increased stability and/or increased carbonic anhydrase activity (e.g., at least 1.5-fold, at least 2-fold, at least 4-fold, or even at least 5-fold increased) under process relevant carbon capture conditions (e.g., high temperature and the presence of high concentrations of $CO_2$ absorption mediating compounds) relative to the same carbonic anhydrase that is not chemically modified. Accordingly, the chemically modified carbonic anhydrases of the present disclosure (and their soluble compositions and homogenous liquid formulations) are capable of improved acceleration of the absorption of carbon dioxide from a gas stream into a solution comprising a $CO_2$ absorption mediating compound (e.g., amines, ammonia, carbonate ion, amino acid) under suitable conditions useful for various carbon capture processes (e.g., flue-gas scrubbers) relative to the acceleration of the same carbonic anhydrase that is not chemically modified. Thus, in various embodiments the present disclosure provides chemically modified carbonic anhydrase polypeptides, and compositions and formulations comprising them, that are capable of catalyzing the hydration of carbon dioxide to bicarbonate or the reverse dehydration of bicarbonate to carbon dioxide with increased activity relative to the same carbonic anhydrases that are not chemically modified (and other known naturally occurring carbonic anhydrases) after exposure to high concentrations of $CO_2$ absorption mediating compound and/or thermal (e.g., T>40° C.). For example, in some embodiments, the chemically modified carbonic anhydrases have carbonic anhydrase activity in 4.2 M MDEA at 50° C. that is increased (e.g., at least 1.5-fold, at least 2-fold, at least 4-fold, or even at least 5-fold increased) relative to the activity of the same carbonic anhydrase polypeptide that is not chemically modified (i.e., unmodified). Similarly, in some embodiments, the chemically modified carbonic anhydrase is characterized by stability in 4.2 M MDEA at 75° C. that is increased (e.g., at least 1.5-fold, at least 2-fold, at least 4-fold, or even at least 5-fold increased) relative to the carbonic anhydrase polypeptide when it is not chemically modified.

In some embodiments the present disclosure provides a soluble composition comprising a carbonic anhydrase polypeptide chemically modified by treatment with a cross-linking agent. In some embodiments of the soluble composition, the carbonic anhydrase polypeptide is a naturally occurring carbonic anhydrase selected from an α-class, γ-class, β-class, or ζ-class carbonic anhydrase, or a recombinant (or engineered) carbonic anhydrase derived from a naturally occurring α-class, γ-class, β-class, or ζ-class carbonic anhydrase. Carbonic anhydrase polypeptides, particularly engineered β-class carbonic anhydrase polypeptides, useful for chemical modification are described in greater detail below.

A wide-range of compounds useful for cross-linking proteins, particularly enzymes, are well-known in the art (see e.g., U.S. Pat. No. 4,101,380, which is hereby incorporated by reference herein) and commercially available (see e.g., catalog of "crosslinking reagents" available from Thermo Scientific, USA at www.piercenet.com). In some embodiments of the soluble composition, the cross-linking agent is selected from the group consisting of a dialdehyde, a bis-imidate ester, a bis(N-hydroxysuccinimide)ester, a diacid chloride, and mixtures thereof. In some embodiments, the specific cross-linking agent is selected from the group consisting of malondialdehyde, glutaraldehyde, dimethyl suberimidate, dimethyl pimelimidate, suberic acid bis(N-hydroxysuccinimide), and mixtures thereof.

In some embodiments of the soluble composition, the cross-linking agent is a dialdehyde optionally having one or more carbon atoms between the two aldehyde groups, for example wherein the dialdehyde is selected from the group consisting of glyoxal, succindialdehyde, malondialdehyde, glutaraldehyde, and mixtures thereof. In addition, the two dialdehyde groups can be linked by a polyethylene glycol group of varying lengths. In a particular embodiment, the cross-linking agent is glutaraldehyde.

In some embodiments of the soluble composition, the cross-linking agent is a bis-imidate ester, and in particular embodiments, a bis-imidate ester optionally having one or more carbon atoms between the two imidate ester groups. Useful imidate esters include bis-imidate esters optionally having one or more carbon atoms between the two imidate ester groups, including but not limited to: imidate esters (such as methyl or ethyl) of oxalimidate, malonimidate, succinimidate, glutarimidate, adipimidate, pimelimidate, and suberimidate. In addition, the two dialdehyde groups can be linked by a polyethylene glycol group of varying lengths.

The cross-linking of proteins using diacid chlorides is known in the art (see e.g., U.S. Pat. No. 4,101,380), and in some embodiments of the soluble composition, the cross-linking agent is a diacid chloride. Diacid chlorides useful in the chemically modified carbonic anhydrase polypeptides of the disclosure include those having structures analogous to the dialdehydes described herein. Accordingly, in some embodiments, the diacid chloride cross-linking agent can optionally having one or more carbon atoms between the two acyl chloride groups, and include, but are not limited to, diacid chloride compounds such as adipoyl chloride. In addition, the two acyl chloride groups can be linked by a polyethylene glycol group of varying lengths.

As shown in the Examples, carbonic anhydrase polypeptides modified with imidate esters may undergo a reversible cleavage reaction, whereby over time, the polypeptide loses the imidate ester chemical modification (i.e., modification undergoes an equilibrium cleavage reaction), and the improved activity and/or stability associated with it. Accordingly, in some embodiments of the soluble composition, the cross-linking agent is a bis(N-hydroxysuccinimide)ester of a di-carboxylic acid that forms an irreversible chemical modification of the polypeptide. Useful bis(N-hydroxysuccinimide)esters include those prepared from a di-carboxylic acid selected from the group consisting of oxalate, malonate, succinate, glutarate, adipate, pimelate, suberate, and mixtures thereof. Accordingly, in particular embodiments of the soluble composition, the cross-linking agent is a bis(N-hydroxysuccinimide)ester of a di-carboxylic acid selected from the group consisting of oxalate, malonate, succinate, glutarate, adipate, pimelate, suberate, and mixtures thereof. In addition, the two ester groups can be linked by a polyethylene glycol group of various length. Also, bis(N-hydroxysulfosuccinimide)esters of di-carboxylic as described above can be used. These have the advantage of being more water soluble than their bis(N-hydroxysuccinimide)ester counterpart due to the addition of a sulfonate group.

Various embodiments of preparing and using the carbonic anhydrase polypeptides chemically modified by treatment with cross-linking agents used in the soluble composition and homogenous liquid formulations are disclosed in greater detail below (see e.g., Examples). Generally, treatment comprises exposure of an unmodified carbonic anhydrase polypeptide (e.g., in an aqueous solution at a concentration of 10 g/L and 100 g/L with the cross-linking agent also in the aqueous solution at a specified concentration. In some embodiments of the soluble composition, the treatment with a cross-linking agent comprises exposure of the carbonic anhydrase polypeptide to the cross-linking agent at a concentration of from about 0.025% to about 10%, from about 0.05% to about 5%, from about 0.1% to about 5%, or from about 0.25% to about 2.5%. In some embodiments, the treatment comprises exposure of the carbonic anhydrase polypeptide to the cross-linking reagent at a concentration of at least about 0.025%, at least about 0.1%, at least about 0.25%, at least about 0.5%, at least about 1%, at least about 2%, at least about 2.5%, or at least about 5%. Generally, either percentage concentrations based on percent volume/volume (v/v) or weight/volume (w/v) can be used with the cross-linking agents disclosed herein without a significant difference in performance for the purposes disclosed herein. Typically, where the cross-linking agent is obtained as a liquid reagent, percent (v/v) is used. For example, as detailed in the Examples, glutaraldehyde is obtained from Sigma-Aldrich (St. Louis, USA) as a 25% solution and further diluted based on percentage (v/v) to the desired polypeptide treatment concentration. However, where the cross-linking agent typically obtained as a solid reagent a percent (w/v) solution can be used.

The structure of the soluble composition can vary depending on the specific carbonic anhydrase polypeptide amino acid sequence that is chemically modified. Generally, regardless of the specific sequence, the cross-linking agents disclosed herein result in chemical modification of one or more amino acid lysine residues, and preferably lysine residues that are present on the surface of the polypeptide or between subunits. Accordingly, in some embodiments of the soluble composition, the carbonic anhydrase polypeptide chemically modified by treatment with a cross-linking agent has at least one chemically modified lysine residue. In some embodiments, the treatment with a cross-linking agent results in the carbonic anhydrase polypeptide having at least one lysine residue cross-linked to another lysine residue on the same carbonic anhydrase polypeptide molecule. In some embodiments, the treatment with a cross-linking agent results in the carbonic anhydrase polypeptide having at least one lysine residue cross-linked to another lysine residue on a different carbonic anhydrase polypeptide molecule (i.e., at least one CA dimer).

In an embodiment of the soluble composition, the carbonic anhydrase polypeptide that is chemically modified is an α-class carbonic anhydrase polypeptide or a recombinant carbonic anhydrase polypeptide derived from an α-class carbonic anhydrase. In some embodiments, the α-class carbonic anhydrase that is chemically modified is an α-class carbonic anhydrase from human (*Homo sapiens*), rat (*Rattus norvegicus*), cow (*Bos taurus*), chicken (*Gallus gallus*), fish (*Cyprino carpio*), or the bacteria, *Neisseria gonorrhoeae*, or a recombinant carbonic anhydrase polypeptide derived from any one of these α-class carbonic anhydrase. In some embodiments, the α-class carbonic anhydrase that is chemically modified comprises an amino acid sequence selected from the group consisting of SEQ ID NO: 1298, 1300, 1302, 1304, 1306, and 1308, or a recombinant carbonic anhydrase polypeptide derived from any one of these α-class carbonic anhydrase sequences.

In another embodiment of the soluble composition, the carbonic anhydrase polypeptide is a recombinant β-class carbonic anhydrase polypeptide derived from the wild-type *Desulfovibrio vulgaris* carbonic anhydrase comprising the amino acid sequence of SEQ ID NO: 2, or derived from a sequence homolog of SEQ ID NO: 2 selected from the group consisting of SEQ ID NO: 1288, 1290, 1292, 1294, and 1296. A wide range of engineered polypeptides useful in such an embodiment of the soluble composition are provide below in Tables 2A, 2B, 2C, 2D, 2E, 2F, 2G, 2H, 2I, and 2J. In some embodiments, the carbonic anhydrase polypeptide amino acid sequence comprises an even-numbered amino acid sequence selected from any one of SEQ ID NO: 4-1286. In such embodiments, the carbonic anhydrase polypeptide amino acid sequence has surface lysine residues at the following positions (relative to SEQ ID NO: 2): X18, X37, X147, X156, X184, or X198. Accordingly, in some embodiments of the soluble composition wherein the polypeptide is a recombinant β-class carbonic anhydrase having an amino acid sequence derived from SEQ ID NO: 2, the treatment with a cross-linking agent results in the carbonic anhydrase polypeptide having a chemically modified lysine residue at one or more of the following positions relative to SEQ ID NO: 2: X18, X37, X147, X156, X184, or X198. In some embodiments of the soluble composition, the carbonic anhydrase polypeptide amino acid sequence comprises at least the following amino acid residue difference relative to SEQ ID NO: 2: X56S. In some embodiments of the soluble composition, the carbonic anhydrase polypeptide amino acid sequence comprises at least the following amino acid residue difference relative to SEQ ID NO: 2: X30R, X40L, X56S, X84Q, X120R, and X139M. In some embodiments of the soluble composition, the carbonic anhydrase polypeptide amino acid sequence an amino acid sequence selected from any one of SEQ ID NO: 26, 190, 206, 238, 252, 270, 274, 284, 306, 318, 328, 332, 340, 354, 596, 606, 656, 678, 1080, 1110, 1148, 1152, 1156, and 1158.

In some embodiments, the present disclosure provides a soluble composition comprising chemically modified polypeptide having carbonic anhydrase activity characterized by an amino acid sequence having at least 80% identity to SEQ ID NO:2 and at least one residue chemically modified by treatment with a cross-linking agent selected from the group consisting of: glutaraldehyde, dimethyl suberimidate, dimethyl pimelimidate, suberic acid bis(N-hydroxysuccinimide), and mixtures thereof. In some embodiments, the at least one residue that is chemically modified by treatment with a cross-linking agent is a surface lysine residue at one or more of the following positions relative to SEQ ID NO: 2: X18, X37, X147, X156, X184, or X198.

As described in greater detail below, the recombinant carbonic anhydrase polypeptides derived from SEQ ID NO: 2 used in the soluble compositions typically have at least one improved enzyme property relative to the wild-type polypeptide of SEQ ID NO: 2. For example increased activity and/or stability in the presence of high concentrations of $CO_2$ absorption mediating compounds (e.g., >4 M MDEA or >2 M $NH_3$) and at increased temperatures (e.g., 40° C. or higher). Thus, in some embodiments of the soluble composition, the carbonic anhydrase polypeptide prior to chemical modification is a recombinant carbonic anhydrase polypeptide having an activity half-life ($t_{1/2}$) of at least 9 hours in 4 M MDEA at 50° C.

Generally, the embodiments of the soluble composition the chemically modified carbonic anhydrase polypeptide of the composition has an improved enzyme property of increased carbonic anhydrase activity and/or increased stability relative to the same carbonic anhydrase polypeptide that is not chemically modified. Thus, in some embodiments of the soluble composition, the carbonic anhydrase activity of the chemically modified carbonic anhydrase is increased relative to the carbonic anhydrase polypeptide when it is not chemically modified (i.e., unmodified), when measured in 4.2 M MDEA at 50° C. In some embodiments the carbonic anhydrase activity is increased at least 1.5-fold, at least 2-fold, at least 3-fold, at least 4-fold, or at least 5-fold.

In some embodiments of the soluble composition, the chemically modified carbonic anhydrase is characterized by the improved enzyme property of increased stability relative to the carbonic anhydrase polypeptide when it is not chemically modified (i.e., unmodified), when measured as residual carbonic anhydrase activity following 24 hours exposure to 4.2 M MDEA at 75° C. In some embodiments the carbonic anhydrase stability is increased at least 1.5-fold, at least 2-fold, at least 3-fold, at least 4-fold, or at least 5-fold.

Due to their improved properties, the soluble compositions comprising chemically modified carbonic anhydrase polypeptides are particularly useful in methods for removing carbon dioxide from a gas stream. Generally, these methods, which are disclosed in greater detail below, comprise the step of contacting under suitable conditions the gas stream with a solution comprising a soluble composition of a chemically modified carbonic anhydrase polypeptide as disclosed herein, whereby the solution absorbs at least a portion of the carbon dioxide from the gas stream.

As mentioned above, the present disclosure also provides a homogenous liquid formulation comprising a carbonic anhydrase polypeptide chemically modified by treatment with a cross-linking agent and a $CO_2$ absorption mediating compound. These homogenous liquid formulations can comprise any of the carbonic anhydrase polypeptides chemically modified by treatment with a cross-linking agent disclosed elsewhere herein. The homogenous liquid formulations of the present disclosure can be prepared by dissolving any of the soluble compositions (disclosed elsewhere herein) in an aqueous solution also comprising the desired $CO_2$ absorption mediating compound. Accordingly, the present disclosure provides a homogenous liquid formulation comprising an aqueous solution of a soluble composition comprising (i) a carbonic anhydrase polypeptide chemically modified by treatment with a cross-linking agent and (ii) a $CO_2$ absorption mediating compound. In various embodiments of the homogenous liquid formulation, the $CO_2$ absorption mediating compound can be selected from the group consisting of an amine compound, ammonia, carbonate ion, and mixtures thereof.

In some embodiments, the $CO_2$ absorption mediating compound used in the homogenous liquid formulation is an amine compound selected from the group consisting of: 2-(2-aminoethylamino)ethanol (AEE), 2-amino-2-hydroxymethyl-1, 3-propanediol (AHPD), 2-amino-2-methyl-1-propanol (AMP), diethanolamine (DEA), diisopropanolamine (DIPA), N-hydroxyethylpiperazine (HEP), N-methyldiethanolamine (MDEA), monoethanolamine (MEA), N-methylpiperazine (MP), piperazine, piperidine, 2-(2-tert-butylaminoethoxy) ethanol (TBEE), triethanolamine (TEA), triisopropanolamine (TIA), tris, 2-(2-aminoethoxy)ethanol, 2-(2-tert-butylaminopropoxy)ethanol, 2-(2-tert-amylaminoethoxy) ethanol, 2-(2-isopropylaminopropoxy)ethanol, 2-(2-(1-methyl-1-ethylpropylamino)ethoxy)ethanol, and mixtures thereof.

Due to their improved properties, the homogenous liquid formulations comprising a chemically modified carbonic anhydrase polypeptide and a $CO_2$ absorption mediating compound, as disclosed herein, also are particularly useful in methods for removing carbon dioxide from a gas stream. Such methods, which are disclosed in greater detail below, generally comprise a step of contacting the gas stream with the homogenous liquid formulation under suitable conditions, whereby the homogenous liquid formulation absorbs at least a portion of the carbon dioxide from the gas stream. In various embodiments, the concentration of the chemically modified carbonic anhydrase polypeptide and/or the $CO_2$ absorption mediating compound in the homogenous liquid formulation can be adjusted depending on the suitable conditions for the particular method of use. Various methods of use for carbon capture processes of the chemically modified carbonic anhydrase polypeptides, and the soluble compositions and homogenous liquid formulation that comprise them, are described in greater detail below, including suitable conditions of polypeptide and $CO_2$ absorption mediating compound concentration, and temperature.

In some embodiments, the improved property of the chemically modified carbonic anhydrase polypeptides (and soluble compositions and homogeneous liquid formulations comprising them) disclosed herein is increased stability in the presence of compounds in the enzyme solution that improve the ability of the solution to absorb carbon dioxide (i.e., compounds that mediate the absorption of $CO_2$ by the solution). Such $CO_2$ absorption mediating compounds increase the amount of carbon dioxide that the solution can absorb, increase the rate at which carbon dioxide is absorbed, and/or improve the thermodynamic properties of the solution that control the carbon dioxide absorption or desorption. Accordingly, the chemically modified carbonic anhydrases, soluble compositions, and homogenous liquid formulations disclosed herein are advantageous for use in methods for carbon dioxide capture and sequestration that use solutions into which carbon dioxide is absorbed (i.e., captured by diffusing from gas stream into the liquid solution) and/or from which carbon dioxide is desorbed (i.e., extracted by diffusing from liquid solution into gas phase). Such compounds, solutions, and solvent systems for the absorption and/or desorption of carbon dioxide and the associated processes of using them for carbon dioxide capture from gas streams are described in e.g., U.S. Pat. Nos. 6,143,556, 6,524,843 B2, 7,176,017 B2, 7,596, 952 B2, 7,641,717 B2, 7,579185 B2, 7,740,689 B2, 7,132, 090 B2; U.S. Pat. Publ. Nos. 2007/0256559A1, 2009/0155889A1, 2010/0086983A1; PCT Publ. Nos. WO2006/089423A1, WO2008/072979A1, WO2009/000025A1, WO2010/020017A1, WO2010/014773A1, WO2010/045689A1, each of which is hereby incorporated by reference herein.

In some embodiments, the improved property of the chemically modified carbonic anhydrase polypeptides, soluble compositions, and homogenous liquid formulations of the present disclosure is increased stability in the presence of an amine compound in the enzyme solution. In addition to increased stability to the presence of amine compound, in such embodiments the carbonic anhydrase can have increased thermostability, e.g., increased activity at temperatures above 40° C. The chemically modified carbonic anhydrase polypeptides disclosed herein having increased stability to amine compounds and increased solution temperature are particularly advantageous for use in methods for carbon dioxide capture and sequestration from flue gas streams using solutions comprising amine compounds (see e.g., U.S. Pat. No. 7,740,689 B2, and U.S. Pat. Publ. 2009/0155889 A1, each of which is hereby incorporated by reference herein) such as those amine compounds selected from the group consisting of: 2-(2-aminoethylamino)ethanol (AEE), 2-amino-2-hydroxymethyl-1,3-propanediol(AHPD), 2-amino-2-methyl-1-propanol (AMP), diethanolamine (DEA), diisopropanolamine (DIPA), N-hydroxyethylpiperazine (HEP), N-methyldiethanolamine (MDEA), monoethanolamine (MEA), N-methylpiperazine (MP), piperazine, piperidine, 2-(2-tert-butylaminoethoxy)ethanol (TBEE), triethanolamine (TEA), triisopropanolamine (TIA), tris, 2-(2-aminoethoxy)ethanol, 2-(2-tert-butylaminopropoxy)ethanol, 2-(2-tert-amylaminoethoxy)ethanol, 2-(2-isopropylaminopropoxy)ethanol, and 2-(2-(1-methyl-1-ethylpropylamino)ethoxy)ethanol.

In some embodiments, the improved property of the chemically modified carbonic anhydrase polypeptides, soluble compositions, and homogenous liquid formulations disclosed herein is increased stability in the presence of ammonia in the enzyme solution. In addition to increased stability to the presence of ammonia, in such embodiments the carbonic anhydrase can have increased stability at increased or decreased temperatures (e.g., less than about 15° C.). The chemically modified carbonic anhydrases disclosed herein having increased stability to ammonia and/or increased thermostability are particularly advantageous for use in methods for carbon dioxide capture and sequestration from flue gas streams using solutions comprising ammonia, such as the chilled ammonia processes (see e.g., U.S. Pat. No. 7,641,717 B2, U.S. Pat. Publ. 2009/0155889 A1, each of which is hereby incorporated by reference herein).

8.3. Preparation of Chemically Modified Carbonic Anhydrase Polypeptides

The present disclosure also provides methods the carbonic anhydrase polypeptides that are chemically modified by treatment with a cross-linking agent, and the soluble compositions and homogenous liquid formulations comprising these chemically modified carbonic anhydrase polypeptides.

In some embodiments the present disclosure provides a method for preparing a chemically modified carbonic anhydrase comprising contacting in a solution: (i) a carbonic anhydrase polypeptide; and (ii) a cross-linking agent selected from the group consisting of a dialdehyde, a bis-imidate ester, a bis(N-hydroxysuccinimide)ester, a diacid chloride, and mixtures thereof.

In various embodiments of the method of preparation, the polypeptide used can comprise any of the wild-type or recombinant carbonic anhydrase polypeptides disclosed herein as useful for chemical modification. Thus, in some embodiments of the method of preparation, the polypeptide comprises an α-class carbonic anhydrase from human (*Homo sapiens*), rat (*Rattus norvegicus*), cow (*Bos taurus*), chicken (*Gallus gallus*), fish (*Cyprino carpio*), or the bacteria, *Neisseria gonorrhoeae*, or a recombinant carbonic anhydrase polypeptide derived from any one of these α-class carbonic anhydrase. For example, the polypeptide used in the method of preparation can comprise the α-class carbonic anhydrase comprises an amino acid sequence selected from the group consisting of SEQ ID NO: 1298, 1300, 1302, 1304, 1306, and 1308, or a recombinant carbonic anhydrase polypeptide derived from any one of these α-class carbonic anhydrase sequences.

In other embodiments, the polypeptide used in the method of preparation can comprise a recombinant β-class carbonic anhydrase polypeptide derived from the wild-type *Desulfovibrio vulgaris* carbonic anhydrase comprising the amino acid sequence of SEQ ID NO: 2, or derived from a sequence homolog of SEQ ID NO: 2 selected from the group consisting of SEQ ID NO: 1288, 1290, 1292, 1294, and 1296. In some embodiments, the polypeptide used in the method of preparation comprises an amino acid sequence having at least 80% identity to SEQ ID NO:2. Exemplary engineered polypeptides useful in the methods of preparation are provide below in Tables 2A, 2B, 2C, 2D, 2E, 2F, 2G, 2H, 2I, and 2J. In some embodiments of the method of preparation, the carbonic anhydrase polypeptide amino acid sequence comprises an even-numbered amino acid sequence selected from any one of SEQ ID NO: 4-1286. In some embodiments, the carbonic anhydrase polypeptide amino acid sequence comprises at least the following amino acid residue difference relative to SEQ ID NO: 2: X56S. In some embodiments, the carbonic anhydrase polypeptide amino acid sequence comprises at least the following amino acid residue difference relative to SEQ ID NO: 2: X30R, X40L, X56S, X84Q, X120R, and X139M. In some embodiments, the carbonic anhydrase polypeptide amino acid sequence an amino acid sequence selected from any one of SEQ ID NO: 26, 190, 206, 238, 252, 270, 274, 284, 306, 318, 328, 332, 340, 354, 596, 606, 656, 678, 1080, 1110, 1148, 1152, 1156, and 1158.

In addition to using a range of polypeptides, the method of preparation of the chemically modified carbonic anhydrase polypeptides, soluble compositions, and homogenous liquid formulations disclosed herein can be carried using a range of cross-linking agents and associated reaction conditions.

In some embodiments of the methods of preparation, the cross-linking agent used is selected from the group consisting of a dialdehyde, a bis-imidate ester, a bis(N-hydroxysuccinimide)ester, a diacid chloride, and mixtures thereof. In some embodiments, the specific cross-linking agent is selected from the group consisting of malondialdehyde, glutaraldehyde, dimethyl suberimidate, dimethyl pimelimidate, suberic acid bis(N-hydroxysuccinimide), and mixtures thereof.

In some embodiments of the methods of preparation, the cross-linking agent used is a dialdehyde having optionally one or more carbon atoms between the two aldehyde groups, for example wherein the dialdehyde is selected from the group consisting of glyoxal, succindialdehyde, malondialdehyde, glutaraldehyde, and mixtures thereof. In a particular embodiment, the cross-linking agent is glutaraldehyde.

In some embodiments of the methods of preparation, the cross-linking agent used is an imidate ester, and in particular embodiments, a bis-imidate ester having optionally one or more carbon atoms between the two imidate ester groups. Useful imidate esters include bis-imidate esters having optionally one or more carbon atoms between the two imidate ester groups, including but not limited to: imidate esters (such as methyl or ethyl) of malonimidate, succinimidate, glutarimidate, adipimidate, pimelimidate, and suberimidate.

In some embodiments of the methods of preparation, the cross-linking agent used is a bis(N-hydroxysuccinimide)ester of a di-carboxylic acid that forms an irreversible chemical modification of the polypeptide. Useful bis(N-hydroxysuccinimide)esters include those prepared from di-carboxylic acid selected from the group consisting of malonate, succinate, glutarate, adipate, pimelate, suberate, and mixtures thereof. Accordingly, in particular embodiments of the soluble composition, the cross-linking agent is a bis(N-hydroxysuccinimide)ester of a di-carboxylic acid selected from the group consisting of malonate, succinate, glutarate, adipate, pimelate, suberate, and mixtures thereof.

Various exemplary reaction conditions useful in the methods of preparing the chemically modified carbonic anhydrase polypeptides are disclosed in greater detail below (see e.g., Examples). Generally, the various embodiments of the methods for preparing comprise contacting in a solution the unmodified carbonic anhydrase polypeptide and the cross-linking agent in an aqueous solution each at a specified concentration. Typically, in the methods of preparation the concentration of the cross-linking agent used in the solution ranges from about 0.1% to about 5% and the concentration of the carbonic anhydrase polypeptide in the solution is from about 10 g/L to about 100 g/L. For example, in particular embodiment of the method of preparation, the concentrations of the cross-linking agent and polypeptide, respectively, are selected from: 0.25% (v/v) and 100 g/L; 0.25% (v/v) and 50 g/L; 0.25% (v/v) and 25 g/L; 0.50% (v/v) and 25 g/L; 0.75% (v/v) and 25 g/L; 1.0% (v/v) and 25 g/L, and 0.25% (v/v) and 10 g/L.

In some embodiments of the method of preparation, the concentration of cross-linking agent in the solution is from about 0.025% to about 10%, from about 0.05% to about 5%, from about 0.1% to about 5%, or from about 0.25% to about 2.5%. In some embodiments, the concentration of cross-linking agent in the solution is at a concentration of at least about 0.025%, at least about 0.1%, at least about 0.25%, at least about 0.5%, at least about 1%, at least about 2%, at least about 2.5%, or at least about 5%. As noted above, either percent volume/volume (v/v) or weight/volume (w/v) can be used with the cross-linking agents disclosed herein without a significant difference in performance of the methods for the purposes disclosed herein. Where the cross-linking agent typically is obtained as a liquid reagent, percent (v/v) is used. For example, as shown in the Examples, glutaraldehyde is obtained from Sigma-Aldrich (St. Louis, USA) as a 25% stock solution and this is further diluted based on percentage (v/v) to the desired concentration for the solution used in the method of preparation. However, where the cross-linking agent typically obtained as a solid reagent a percent (w/v) solution can be used.

In some embodiments of the method of preparation, the concentration of the carbonic anhydrase polypeptide in the solution is from about 0.1 g/L to about 100 g/L, from about 1 g/L to about 100 g/L, or from about 10 g/L to about 100 g/L. In some embodiments, the concentration of the carbonic anhydrase polypeptide in the solution is at least about 0.1 g/L, at least about 1 g/L, at least about 5 g/L, at least about 10 g/L, at least about 25 g/L, at least about 50 g/L, or at least about 100 g/L.

In some embodiments of the method of preparation, the cross-linking agent is glutaraldehyde, and the concentration of the cross-linking agent in the solution is about 0.25% and the concentration of the carbonic anhydrase polypeptide in the solution is from about 10 g/L to about 100 g/L. In particular embodiments of the method of preparation, the concentrations of glutaraldehyde cross-linking agent and polypeptide, respectively, are selected from: 0.25% (v/v) and 100 g/L; 0.25% (v/v) and 50 g/L; 0.25% (v/v) and 25 g/L; 0.50% (v/v) and 25 g/L; 0.75% (v/v) and 25 g/L; 1.0% (v/v) and 25 g/L, and 0.25% (v/v) and 10 g/L.

In some embodiments, the method of preparation can be carried out wherein the solution in prepared by adding a carbonic anhydrase polypeptide to an aqueous solution in the form of a powder. The powder may contain the polypeptide in a partially purified or a highly purified form prepared from cell extracts or cell lysates (e.g., shake-flask powder, or DSP powder). In some embodiments, the cell extracts or cell lysates used may be partially purified by precipitation (ammonium sulfate, polyethyleneimine, heat treatment or the like, followed by a desalting procedure prior to lyophilization (e.g., ultrafiltration, dialysis, and the like). Any of the cell preparations may be stabilized by crosslinking using known crosslinking agents, such as, for example, glutaraldehyde or immobilization to a solid phase (e.g., Eupergit C, and the like) or by the crosslinking of protein crystals or precipitated protein aggregate particles.

Other conditions used in the embodiments of the method of preparation include an incubation time of 1 h to 4 h, and an incubation temperature of about room temperature (e.g., about 25° C.), or about 20° C. to about 30° C. Additionally, the aqueous solution may further comprise buffer salts at concentrations typically used with the particular polypeptide (e.g., triethanolamine sulfate or sodium bicarbonate at about pH 7.7 to about pH 10).

8.4. Carbonic Anhydrase Polypeptides Useful for Chemical Modification

The present disclosure provides carbonic anhydrase polypeptides that are chemically modified by treatment with a cross-linking agent and resulting in the surprising advantage of improved properties of increased carbonic anhydrase activity and/or increased stability under conditions useful for carbon capture process, e.g., in homogenous liquid formulations with high concentrations of $CO_2$ absorption mediating compounds and temperatures significantly increased or decreased above/below ambient temperature. The present disclosure contemplates that chemically modified carbonic anhydrase polypeptides can be prepared using any naturally occurring or recombinant (engineered) carbonic anhydrase polypeptide. Accordingly, in some embodiments of the compositions, formulations and methods of the present disclosure, the carbonic anhydrase that is chemically modified is selected from an α-class, γ-class, β-class, or ζ-class carbonic anhydrase.

In some embodiments, the present disclosure provides particular emphasis on the use of carbonic anhydrase polypeptides that already exhibit favorable properties of increased activity and stability under carbon capture process conditions. The α-class carbonic anhydrases, particularly the human carbonic anhydrase II ("HuCAII"), are among the fastest known enzymes, and generally have the highest specific carbonic anhydrase activity of the various classes. Accordingly, in some embodiments of the compositions, formulations and methods of the present disclosure, the carbonic anhydrase that is chemically modified is an α-class carbonic anhydrase polypeptide or a recombinant carbonic anhydrase polypeptide derived from an α-class carbonic anhydrase. In some embodiments, the α-class carbonic anhydrase that is chemically modified is an α-class carbonic anhydrase from human (*Homo sapiens*), rat (*Rattus norvegicus*), cow (*Bos taurus*), chicken (*Gallus gallus*), fish (*Cyprino carpio*), or the bacteria, *Neisseria gonorrhoeae*, or a recombinant carbonic anhydrase polypeptide derived from any one of these α-class carbonic anhydrase. In some embodiments, the α-class carbonic anhydrase that is chemically modified comprises an amino acid sequence selected from the group consisting of SEQ ID NO: 1298, 1300, 1302, 1304, 1306, and 1308, or a recombinant carbonic anhydrase polypeptide derived from any one of these α-class carbonic anhydrase sequences.

Although naturally occurring β-class carbonic anhydrases have been found that exhibit relatively high thermostability (e.g., β-class carbonic anhydrase from *Methanobacterium thermoautotrophicum*), most β-class enzymes exhibit significantly lower specific activity in catalyzing the hydration of $CO_2$ than the α-class carbonic anhydrases such as the α-class HuCAII of SEQ ID NO: 1298. For example, in a bicarbonate dehydration assay at pH 8.0, 25° C., the β-class CA from *M. thermoautotrophicum* exhibits less than 4% of the specific activity of the α-class HuCAII. However, the β-class carbonic anhydrase from *Desulfovibrio vulgaris* exhibits a high specific activity that is comparable to an α-class enzymes and also exhibits high thermostability. For example, in the same bicarbonate dehydration assay comparison to the α-class HuCAII of SEQ ID NO: 1298, the wild-type β-class carbonic anhydrase from *D. vulgaris* of SEQ ID NO: 2 was exhibited 84% of the specific activity of HuCAII, and more than 20-fold the activity exhibited by β-class CA from *M. thermoautotrophicum*. Several naturally occurring β-class carbonic anhydrases have been identified that are sequence homologs having over 40% identity to the *D. vulgaris* enzyme of SEQ ID NO: 2. These include a β-class carbonic anhydrases from: *Desulfovibrio* sp. FW1012B (SEQ ID NO: 1288); *Desulfomicrobium baculatum* strain DSM 4028 (SEQ ID NO: 1290); *Desulfovibrio aespoeensis* (SEQ ID NO: 1292); *Desulfovibrio desulfuricans* strain G20 (SEQ ID NO: 1294); and *Desulfovibrio magneticus* strain ATCC 700980 (SEQ ID NO: 1296).

Accordingly, in some embodiments of the compositions, formulations and methods of the present disclosure, the carbonic anhydrase that is chemically modified is a β-class carbonic anhydrase polypeptide or a recombinant carbonic anhydrase polypeptide derived from a β-class carbonic anhydrase. In some embodiments, the β-class carbonic anhydrase comprises an amino acid sequence selected from the group consisting of SEQ ID NO: 2, 1288, 1290, 1292, 1294, and 1296. In some embodiments, the β-class carbonic anhydrase is a recombinant carbonic anhydrase polypeptide derived from a β-class carbonic anhydrase from *Desulfovibrio vulgaris*, and in some embodiments comprises an amino acid sequence having at least 80% identity to SEQ ID NO: 2.

As described in greater detail below, the β-class carbonic anhydrase from *Desulfovibrio vulgaris* of SEQ ID NO: 2 has been further engineered to provide recombinant carbonic anhydrase polypeptides having an improved property when compared with the naturally-occurring, wild type carbonic anhydrase enzyme obtained from *Desulfovibrio vulgaris* (SEQ ID NO: 2). These recombinant carbonic anhydrase polypeptides comprise one or more differences in their amino acid sequence (e.g., substitutions, insertions, and/or deletions) relative to a reference sequence (e.g., *Desulfovibrio vulgaris* CA polypeptide of SEQ ID NO: 2) that result in a carbonic anhydrase polypeptide having an improved property. The improved properties of these recombinant CA polypeptides include, but are not limited to, activity (e.g., hydration of carbon dioxide, or dehydration of bicarbonate), thermal stability, solvent stability, pH activity profile, refractoriness to inhibition or inactivation by other compounds in the solution with the enzyme, e.g. inhibition by bicarbonate, carbonate, amine compounds, ammonia, flue gas components (such as $NO_x$ and $SO_x$ compounds).

In some embodiments, the improved property of the engineered carbonic anhydrase polypeptide is with respect to an increase in its rate of conversion of the substrate to the product (e.g., hydration of carbon dioxide to bicarbonate). This improvement in enzymatic activity can be manifested by the ability to use less of the recombinant polypeptide as compared to a reference polypeptide and thereby reduce the amount of enzyme needed to convert the same amount of product.

In some embodiments, the improved property of the engineered carbonic anhydrase polypeptide is with respect to its thermostability. Accordingly, in some embodiments the recombinant carbonic anhydrase polypeptides have an improved property that comprises at least 1.2-fold, at least 1.3-fold, at least 1.5-fold, at least 2-fold, at least 3-fold, at least 4-fold, at least 5-fold, at least 10-fold, or at least 25-fold increased thermostability. In such embodiments, increased thermostability can be determined as increased activity relative to a reference polypeptide following exposure to thermostability challenge conditions—e.g., exposure to 30, 40, 50, or 60° C. solution for a defined time period, such as 24 h. In some embodiments, the carbonic anhydrase polypeptide has more than one improved property, such as a combination of increased enzyme activity and thermostability.

The present disclosure contemplates that any of these engineered carbonic anhydrase polypeptides having improved properties can be chemically modified by treatment with a cross-linking agent and used in the methods of carbon capture disclosed herein.

Exemplary recombinant carbonic anhydrase polypeptides useful for chemical modification according to the present disclosure include but are not limited to, the polypeptides that comprise the amino acid sequences corresponding to any one of SEQ ID NOs: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, 1086, 1088, 1090, 1092, 1094, 1096, 1098, 1100, 1102, 1104, 1106, 1108, 1110, 1112, 1114, 1116, 1118, 1120, 1122, 1124, 1126, 1128, 1130, 1132, 1134, 1136, 1138, 1140, 1142, 1144, 1146, 1148, 1150, 1152, 1154, 1156, 1158, 1160, 1162, 1164, 1166, 1168, 1170, 1172, 1174, 1176, 1178, 1180, 1182, 1184, 1186, 1188, 1190, 1192, 1194, 1196, 1198, 1200, 1202, 1204, 1206, 1208, 1210, 1212, 1214, 1216, 1218, 1220, 1222, 1224, 1226, 1228, 1230, 1232, 1234, 1236, 1238, 1240, 1242, 1244, 1246, 1248, 1250, 1252, 1254, 1256, 1258, 1260, 1262, 1264, 1266, 1268, 1270, 1272, 1274, 1276, 1278, 1280, 1282, 1284, and 1286.

Structure and function information for these exemplary recombinant carbonic anhydrase polypeptides of the present disclosure are shown below in Tables 2A, 2B, 2C, 2D, 2E, 2F, 2G, 2H, 2I, and 2J. The odd numbered sequence identifiers (i.e., SEQ ID NOs) refer to the nucleotide sequence encoding the amino acid sequence provided by the even numbered SEQ ID NOs, and the sequences are provided in the electronic sequence listing file accompanying this disclosure, which is hereby incorporated by reference herein. The amino acid residue differences are based on comparison to the reference sequence of SEQ ID NO: 2, which is a wild type carbonic anhydrase from *Desulfovibrio vulgaris* str. "Miyazaki F" having GenBank accession ACL09337.1 GI:218758438.

Tables 2A, 2B, 2C, 2D, 2E, 2F, 2G, 2H, 2I, and 2J also disclose the increased stability (solvent and/or thermostability) in the presence of an amine compound (MDEA) and/or ammonia at various concentrations and temperatures relative to the reference polypeptide of SEQ ID NO: 2. Generally, increased stability was determined by measuring the relative rate of dehydrating bicarbonate to carbon dioxide in a high-throughput (HTP) assay following 24 h exposure to the specified solvent and temperature challenge conditions, and HTP activity assays were carried out in 96-well plate format assay using cell lysates containing the engineered polypeptides. General HTP challenge/assay conditions were as follows: 25 μL of cleared *E. coli* lysate added to 75 μL of challenge buffer solution (e.g., solution containing 4.0 M-6.66 M MDEA or $NH_3$) and incubated at the challenge temperature (e.g., 30°, 35°, 42°, 50° or 55° C.) for 24 h; followed by adding a 10 μL aliquot of the challenge solution to 190 μL of bicarbonate dehydration assay solution (200 mM $KHCO_3$, 400 μM phenolphthalein, pH 7 or 8) at 25° C. or 45° C., measuring carbonic anhydrase activity as slope of phenolphthalein indicator absorbance change at 550 nm over 20-30 minutes. Additional HTP assay details are provided in Example 1. As noted in Tables 2A, 2B, 2C, 2D, 2E, 2F, 2G, 2H, 2I, and 2J, the measured level of increased activity of each engineered polypeptide relative to a reference polypeptide was classified as "+", "++", or "+++" for the different assays.

TABLE 2A

| SEQ ID NO: (nt/aa) | Amino Acid Residue Difference(s) (relative to SEQ ID NO: 2) | Assay 1 (24 h/42° C./ 3M MDEA challenge/ 25° C. assay) | Assay 2 (24 h/50° C./ 3M MDEA challenge/ 25° C. assay) | Assay 3 (24 h/30° C./ 4.2M $NH_3/CO_2$ challenge/ 25° C. assay) | Assay 4 (24 h/35° C./ 4.2M $NH_3/CO_2$ challenge/ 25° C. assay) |
|---|---|---|---|---|---|
| 3/4 | K147E; | +++ | +++ | | |
| 5/6 | T30R; | +++ | | ++ | +++ |
| 7/8 | T139M; | +++ | ++ | | |
| 9/10 | G120R; | +++ | | | |
| 11/12 | T30Q; | +++ | | ++ | ++ |
| 13/14 | T4F; | +++ | + | + | ++ |
| 15/16 | A84Q; | +++ | +++ | ++ | ++ |
| 17/18 | Q119M; | +++ | | | |
| 19/20 | L34H; | +++ | | ++ | ++ |
| 21/22 | T4M; T30K; | ++ | | +++ | +++ |
| 23/24 | K147T; | ++ | +++ | | |
| 25/26 | A56S; | ++ | +++ | ++ | ++ |
| 27/28 | Q32K; | ++ | | + | ++ |
| 29/30 | V131L; | ++ | + | + | |
| 31/32 | Q15R; T30R; | ++ | ++ | +++ | +++ |
| 33/34 | N145W; | ++ | | | |
| 35/36 | R16S; | ++ | | | |
| 37/38 | A40W; | ++ | | + | + |
| 39/40 | N213E; | ++ | | | |
| 41/42 | H222C; | ++ | | ++ | +++ |
| 43/44 | E142L; | ++ | | | |
| 45/46 | G2T; | ++ | ++ | | |
| 47/48 | R31P; | ++ | + | | |
| 49/50 | S144L; | ++ | | | |
| 51/52 | E159H; | ++ | | | |
| 53/54 | T139Q; | ++ | | | |
| 55/56 | H148T; | ++ | | | |
| 57/58 | M170F; | ++ | + | + | |
| 59/60 | D86A | | | | |
| 61/62 | A121K; | ++ | + | + | |
| 63/64 | N145F; | ++ | | | |
| 65/66 | Q32R; | ++ | | ++ | + |
| 67/68 | A121W; | ++ | + | + | ++ |
| 69/70 | K37R; | ++ | | + | ++ |
| 71/72 | A221C; | ++ | | ++ | ++ |
| 73/74 | A84S; | ++ | | | |
| 75/76 | E200R; | ++ | | | |
| 77/78 | T139K; | ++ | | | |
| 79/80 | A95V; | ++ | | + | + |
| 81/82 | A84N; | + | | + | |
| 83/84 | Q43M; | + | | | |
| 85/86 | A121V; | + | | | |
| 87/88 | K147G; | + | | | |
| 89/90 | R223C; | + | | ++ | ++ |
| 91/92 | T30A; | + | | ++ | ++ |
| 93/94 | G2R; | + | | + | + |
| 95/96 | A121H; | + | | + | |
| 97/98 | A121Q; | + | | + | + |
| 99/100 | A60C; | + | | ++ | ++ |
| 101/102 | D96C; | + | | | |
| 103/104 | T30L; | + | | ++ | + |
| 105/106 | A40L; | + | + | + | |
| 107/108 | H97F; | + | | | |
| 109/110 | E68A; | | | + | + |
| 111/112 | S42A; A219T; | | | + | + |
| 113/114 | V70I; | + | | ++ | ++ |
| 115/116 | Q119T; | + | | | |
| 117/118 | D96E; | + | | + | |
| 119/120 | S35A; | + | | + | ++ |

TABLE 2A-continued

| SEQ ID NO: (nt/aa) | Amino Acid Residue Difference(s) (relative to SEQ ID NO: 2) | Assay 1 (24 h/42° C./ 3M MDEA challenge/ 25° C. assay) | Assay 2 (24 h/50° C./ 3M MDEA challenge/ 25° C. assay) | Assay 3 (24 h/30° C./ 4.2M $NH_3/CO_2$ challenge/ 25° C. assay) | Assay 4 (24 h/35° C./ 4.2M $NH_3/CO_2$ challenge/ 25° C. assay) |
|---|---|---|---|---|---|
| 121/122 | H124G; | + | | + | |
| 123/124 | Q119K; | + | | | |
| 125/126 | V138L; | + | | | |
| 127/128 | D168E; | + | | | |
| 129/130 | T139H; | + | | | |
| 131/132 | A121T; | + | | + | + |
| 133/134 | A121L; | + | | | |
| 135/136 | S144A; | + | | | |
| 137/138 | N145C; | + | | | |
| 139/140 | N213Q; | + | | | |
| 141/142 | D96K; | + | | | |
| 143/144 | A178G; | + | | | |
| 145/146 | H124R; | + | | | |
| 147/148 | D96A; | + | | | |
| 149/150 | S35R; | + | | + | + |
| 151/152 | E159V; | + | | | |
| 153/154 | T47R; | + | | + | |
| 155/156 | H148A; | + | | | |
| 157/158 | A84R; | + | | ++ | ++ |
| 159/160 | Q43V; | + | | | |
| 161/162 | E159R; | + | | | |
| 163/164 | K147F; | + | | | |
| 165/166 | E68G; | + | | + | + |
| 167/168 | V157A; | | | + | + |
| 169/170 | V138W; | | | + | |
| 171/172 | V138F; | | | + | |
| 173/174 | R223Q; | | | + | ++ |
| 175/176 | M207E; | | | + | |
| 177/178 | A84K; | | | ++ | + |
| 179/180 | A60V; | | | ++ | ++ |
| 181/182 | A40Q; | | | ++ | + |
| 183/184 | A22G; | | | ++ | |
| 185/186 | K143M; M207N; | | | | |

Levels of increased activity were determined relative to the reference polypeptide of SEQ ID NO: 2 and defined as "+", "++", or "+++" for each of the four assays as follows:
Assay 1: "+" = at least 1.3-fold but less than 2-fold increased activity; "++" = at least 2-fold but less than 3-fold increased activity; "+++" = at least 3-fold increased activity.
Assay 2: "+" = at least 1.5-fold but less than 2-fold increased activity; "++" = at least 2-fold but less than 3-fold increased activity; "+++" = at least 3-fold increased activity.
Assay 3: "+" = at least 1.3-fold but less than 1.5-fold increased activity; "++" = at least 1.5-fold but less than 2-fold increased activity; "+++" = at least 2-fold increased activity.
Assay 4: "+" = at least 1.3-fold but less than 3-fold increased activity; "++" = at least 3-fold but less than 5-fold increased activity; "+++" = at least 5-fold increased activity.

TABLE 2B

| SEQ ID NO: (nt/aa) | Amino Acid Residue Difference(s) (relative to SEQ ID NO: 2) | Assay 5 (24 h/50° C./ 4M MDEA challenge/ 45° C. assay) | Assay 6 (24 h/50° C./ 5M MDEA challenge/ 25° C. assay) | Assay 7 (24 h/55° C./ 5M MDEA challenge/ 25° C. assay) |
|---|---|---|---|---|
| 187/188 | T30R; R31P; A56S; A84Q; | ++ | +++ | +++ |
| 189/190 | A56S; A84Q; T139M; | ++ | +++ | +++ |
| 191/192 | T30R; R31P; A40L; A56S; G120R; | +++ | +++ | +++ |
| 193/194 | R31P; A40L; A56S; G120R; T139M; | +++ | +++ | +++ |
| 195/196 | T30R; R31P; A56S; A84Q; Q119M; | +++ | +++ | +++ |
| 197/198 | R31P; A40L; A56S; A84Q; | +++ | +++ | +++ |
| 199/200 | T30Q; R31P; A56S; A84Q; | +++ | +++ | +++ |
| 201/202 | T30Q; L34H; A56S; | +++ | +++ | ++ |
| 203/204 | T30R; R31P; A40L; A56S; K147T; | +++ | +++ | +++ |
| 205/206 | T30R; R31P; A56S; K147T; | +++ | +++ | +++ |
| 207/208 | T4F; A56S; A84Q; | ++ | ++ | ++ |
| 209/210 | T30R; L34H; A56S; | ++ | ++ | ++ |
| 211/212 | A56S; T139M; | + | + | + |
| 213/214 | G2T; R31P; L34H; A40L; A56S; A84Q; T139M; | + | + | ++ |
| 215/216 | T4F; L34H; A56S; G120R; K147E; | + | + | + |
| 217/218 | A40L; A56S; | ++ | + | + |
| 219/220 | R31P; A40L; A56S; Q119M; G120R; | ++ | + | ++ |
| 221/222 | R31P; A56S; G120R; K147E; | ++ | + | |
| 223/224 | T4F; A40L; A56S; K147T; | ++ | + | + |
| 225/226 | R31P; A40L; A56S; | ++ | + | + |
| 227/228 | A56S; A84Q; | ++ | + | + |

TABLE 2B-continued

| SEQ ID NO: (nt/aa) | Amino Acid Residue Difference(s) (relative to SEQ ID NO: 2) | Assay 5 (24 h/50° C./ 4M MDEA challenge/ 45° C. assay) | Assay 6 (24 h/50° C./ 5M MDEA challenge/ 25° C. assay) | Assay 7 (24 h/55° C./ 5M MDEA challenge/ 25° C. assay) |
|---|---|---|---|---|
| 229/230 | T30R; A40L; A56S; | ++ | + | ++ |
| 231/232 | T30Q; L34H; A56S; K147T; | ++ | + | ++ |
| 233/234 | L34H; A56S; | ++ | + | + |
| 235/236 | T30R; R31P; A56S; | +++ | + | ++ |
| 237/238 | T30R; A56S; | +++ | + | + |
| 239/240 | R31P; A56S; A84Q; | +++ | + | ++ |
| 241/242 | T4F; A56S; | | | + |
| 243/244 | G2T; A56S; T139M; | | | + |
| 245/246 | A56S; G120R; K147T; | + | | |
| 247/248 | G2T; A56S; A84Q; T139M; | + | | + |
| 249/250 | A56S; Q119L; G120R; | + | | + |
| 251/252 | A40L; A56S; G120R; | + | | + |
| 253/254 | A56S; K147T; | + | | |
| 255/256 | A40L; A56S; T139M; K147E; | + | | |
| 257/258 | A40L; A56S; T139M; | ++ | | |
| 259/260 | T4F; T30Q; A56S; G120R; T139M; | ++ | | + |
| 261/262 | L34H; A56S; A84Q; T139M; | ++ | | ++ |
| 263/264 | A56S; A84Q; K147E; | ++ | | + |
| 265/266 | A56S; A84Q; G120R; | ++ | | + |
| 267/268 | T30R; R31P; A56S; T139M; | ++ | | ++ |

Levels of increased activity were determined relative to the reference polypeptide of SEQ ID NO 26 (i.e., engineered polypeptide having A56S) and defined as "+", "++", or "+++" for each of the assays as follows:
Assay 5: "+" indicates at least 1.5-fold but less than 2.5-fold increased activity; "++" indicates at least 2.5-fold but less than 4-fold increased activity; "+++" indicates at least 4-fold increased activity.
Assay 6: "+" indicates at least 1.3-fold but less than 1.7-fold increased activity; "++" indicates at least 1.7-fold but less than 2-fold increased activity; "+++" indicates at least 2-fold increased activity.
Assay 7: "+" indicates at least 1.5-fold but less than 2.5-fold increased activity; "++" indicates at least 2.5-fold but less than 4-fold increased activity; "+++" indicates at least 4-fold increased activity.

TABLE 2C

| SEQ ID NO: (nt/aa) | Amino Acid Residue Difference(s) (relative to SEQ ID N0: 2) | Assay 5 (24 h/50° C./ 4M MDEA challenge/ 45° C. assay) |
|---|---|---|
| 269/270 | T30Q; A40L; A56S; A84Q; | +++ |
| 271/272 | A40L; A56S; A84Q; G120R; K147E; | +++ |
| 273/274 | T30R; R31P; L34H; A40L; A56S; A84Q; G120R; T139M; K147T; | +++ |
| 275/276 | R31P; A40L; A56S; Q119M; T139M; K147T; | +++ |
| 277/278 | G2T; A40L; A56S; Q119M; G120R; K147T; | ++ |
| 279/280 | G2T; T30Q; L34H; A56S; Q119M; K147T; | ++ |
| 281/282 | T30R; A40L; A56S; A84Q; G120R; K147T; | +++ |
| 283/284 | L34H; A56S; T139M; K147T; | +++ |
| 285/286 | R31P; A40L; A56S; K147E; | ++ |
| 287/288 | A40L; A56S; G120R; T139M; K147E; | ++ |
| 289/290 | G2T; T30Q; A40L; A56S; A84Q; K147E; | ++ |
| 291/292 | A56S; A84Q; G120R; T139M; K147E; | +++ |
| 293/294 | T4F; T30Q; A56S; A84Q; T139M; | +++ |
| 295/296 | T30Q; A56S; A84Q; Q119M; G120R; T139M; K147E; | +++ |
| 297/298 | G2T; T4F; T30Q; R31P; A40L; A56S; A84Q; | +++ |
| 299/300 | T4F; A40L; A56S; A84Q; T139M; | +++ |
| 301/302 | G2T; T30R; A56S; Q119M; T139M; | ++ |
| 303/304 | A56S; A84Q; G120R; T139M; K147T; | +++ |
| 305/306 | T30R; R31P; A40L; A56S; T139M; | +++ |
| 307/308 | T4F; A56S; A84Q; T139M; | +++ |
| 309/310 | T30R; R31P; A56S; Q119M; G120R; | +++ |
| 311/312 | G2T; T4F; A40L; A56S; Q119M; G120R; T139M; | ++ |
| 313/314 | R31P; A56S; A84Q; Q119M; | ++ |
| 315/316 | G2T; A40L; A56S; Q119M; G120R; | + |
| 317/318 | R31P; A56S; A84Q; G120R; T139M; | +++ |
| 319/320 | T4F; T30Q; R31P; A56S; G120R; K147T; | +++ |
| 321/322 | T30Q; R31P; L34H; A56S; A84Q; T139M; | +++ |
| 323/324 | T4F; T30Q; R31P; L34H; A40L; A56S; Q119M; T139M; K147T; | +++ |
| 325/326 | L34H; A56S; G120R; K147E; | ++ |
| 327/328 | G2T; A40L; A56S; A84Q; G120R; T139M; K147T; | ++ |
| 329/330 | A56S; G120R; | + |
| 331/332 | T30R; A40L; A56S; A84Q; G120R; T139M; | +++ |
| 333/334 | T30R; A40L; A56S; A84Q; G120R; T139M; K147E; | +++ |
| 335/336 | R31P; L34H; A56S; G120R; | +++ |
| 337/338 | R31P; L34H; A40L; A56S; T139M; K147T; | +++ |
| 339/340 | G2T; T30R; A40L; A56S; | ++ |

TABLE 2C-continued

| SEQ ID NO: (nt/aa) | Amino Acid Residue Difference(s) (relative to SEQ ID N0: 2) | Assay 5 (24 h/50° C./ 4M MDEA challenge/ 45° C. assay) |
|---|---|---|
| 341/342 | G2T; T30R; A56S; G120R; T139M; K147E; | ++ |
| 343/344 | T30R; A56S; Q119M; G120R; | +++ |
| 345/346 | T4F; T30Q; L34H; A40L; A56S; A84Q; G120R; T139M; | +++ |
| 347/348 | T30R; R31P; L34H; A40L; A56S; A84Q; Q119M; K147T; | +++ |
| 349/350 | T4F; A40L; A56S; Q119M; G120R; K147T; | +++ |
| 351/352 | G2T; T4F; T30R; R31P; L34H; A56S; G120R; T139M; | ++ |
| 353/354 | T4F; T30R; A40L; A56S; | +++ |
| 355/356 | R31P; L34H; A56S; T139M; | +++ |
| 357/358 | L34H; A40L; A56S; A84Q; Q119M; T139M; | +++ |
| 359/360 | G2T; T4F; L34H; A56S; A84Q; Q119M; G120R; K147E; | ++ |
| 361/362 | R31P; A40W; A56S; A95V; N145W; K147T; | ++ |
| 363/364 | R31P; A40W; A56S; T139Q; N145L; E159V; A221C; | + |
| 365/366 | R31P; A40W; A56S; A95V; T139Q; N145W; E159V; N213E; | ++ |
| 367/368 | A40W; A56S; A95V; N213E; | ++ |
| 369/370 | R31P; A56S; A95V; T139K; N145F; K147E; | ++ |
| 371/372 | A40W; A56S; A95V; V131F; T139K; K147E; E159V; N213E; | + |
| 373/374 | R31P; A56S; V131F; K147E; E159H; A221C; | + |
| 375/376 | A56S; V131F; T139K; N145L; E159V; A221C; | + |
| 377/378 | R31P; A40W; A56S; A95V; A121L; A221C; | ++ |
| 379/380 | R31P; A40W; A56S; A95V; T139Q; | + |
| 381/382 | A40W; A56S; A95V; V131F; E159V; N213E; | + |
| 383/384 | R31P; A40W; A56S; A121L; V131F; T139Q; E159H; N213E; | + |
| 385/386 | A40W; A56S; A95V; E159V; N213E; | + |
| 387/388 | A40W; A56S; | + |
| 389/390 | R31P; A56S; A95V; A121W; A221C; | ++ |
| 391/392 | A40W; A56S; T139K; | + |
| 393/394 | A56S; A121V; T139K; N213E; A221C; | + |
| 395/396 | A56S; A121K; | + |
| 397/398 | A56S; T139K; N145F; E159H; A221C; | + |
| 399/400 | R31P; A40W; A56S; A95V; A121V; N145W; K147E; N213E; | ++ |
| 401/402 | R31P; A40W; A56S; A95V; A121K; | + |
| 403/404 | R31P; A40W; A56S; A95V; T139Q; N145F; N213E; | ++ |
| 405/406 | R31P; A56S; A95V; A121W; T139K; N145F; K147T; | ++ |
| 407/408 | R31P; A40W; A56S; A95V; A121V; K147T; N213E; | ++ |
| 409/410 | A56S; A121V; T139Q; K147T; | + |
| 411/412 | R31P; A40W; A56S; N145F; | ++ |
| 413/414 | A56S; A121W; | + |
| 415/416 | R31P; A40W; A56S; A95V; A121W; T139Q; E159V; N213E; | ++ |
| 417/418 | R31P; A40W; A56S; A221C; | + |
| 419/420 | R31P; A40W; A56S; A95V; N145F; | ++ |
| 421/422 | A40W; A56S; A95V; A121K; V131F; K147T; | + |
| 423/424 | A40W; A56S; V131F; N145F; K147E; | + |
| 425/426 | A40W; A56S; T139K; N145F; A221C; | ++ |
| 427/428 | A40W; A56S; A121V; | ++ |
| 429/430 | R31P; A40W; A56S; T139Q; | + |
| 431/432 | R31P; A56S; A121W; T139Q; | + |
| 433/434 | A40W; A56S; A95V; | + |
| 435/436 | R31P; A56S; A95V; V131F; T139K; K147T; E159H; | + |
| 437/438 | A56S; N213E; A221C; | + |
| 439/440 | A40W; A56S; T139Q; K147T; A221C; | ++ |
| 441/442 | R31P; A56S; A95V; T139K; K147E; | ++ |
| 443/444 | R31P; A40W; A56S; V131F; T139Q; | + |
| 445/446 | R31P; A56S; A95V; A121W; | + |
| 447/448 | A40W; A56S; A95V; A121L; N213E; | + |
| 449/450 | R31P; A56S; T139K; | ++ |
| 451/452 | A56S; A95V; A121V; N145F; K147E; E159V; | + |
| 453/454 | A56S; A95V; A121L; E159V; N213E; | ++ |
| 455/456 | R31P; A40W; A56S; A121W; N145F; A221C; | + |
| 457/458 | A40W; A56S; N145F; K147T; N213E; | ++ |
| 459/460 | R31P; A56S; A95V; E159V; | ++ |
| 461/462 | R31P; A56S; A95V; A121K; E159H; A221C; | + |
| 463/464 | R31P; A40W; A56S; A121K; V131F; T139Q; N213E; | + |
| 465/466 | A56S; V131F; K147T; | + |
| 467/468 | A56S; E159V; N213E; A221C; | ++ |
| 469/470 | S42A; T47R; A56S; E68A; A95V; V138L; A221C; | + |
| 471/472 | A56S; E68A; H97F; V138L; S144L; | + |
| 473/474 | S35A; A56S; E68A; H97F; S144L; A219T; A221C; | + |
| 475/476 | S35R; A56S; E68A; S144L; | + |
| 477/478 | S42A; A56S; H97F; H124G; A219T; A221C; | + |
| 479/480 | S42A; T47R; A56S; A95V; H97F; H124R; A219T; | + |
| 481/482 | A56S; H124R; S144L; | + |
| 483/484 | S42A; T47R; A56S; A95V; V157A; | + |
| 485/486 | S42A; T47R; A56S; E68A; A95V; | + |
| 487/488 | A56S; A95V; H97F; H124G; S144L; V157A; | + |

TABLE 2C-continued

| SEQ ID NO: (nt/aa) | Amino Acid Residue Difference(s) (relative to SEQ ID N0: 2) | Assay 5 (24 h/50° C./ 4M MDEA challenge/ 45° C. assay) |
|---|---|---|
| 489/490 | S42A; T47R; A56S; E68A; A95V; H124G; V157A; | + |
| 491/492 | S42A; A56S; V70I; A95V; A221C; | + |
| 493/494 | A56S; V157A; | + |
| 495/496 | S35R; T47R; A56S; E68A; V70I; A95V; | + |
| 497/498 | T47R; A56S; A95V; H124R; A221C; | + |
| 499/500 | A56S; E68A; A95V; H97F; H124R; V138L; S144L; V157A; | + |
| 501/502 | T47R; A56S; E68A; H97F; V138L; A219T; | + |
| 503/504 | A56S; V138L; S144L; | + |
| 505/506 | S35A; S42A; T47R; A56S; E68A; V70I; H97F; V138L; S144L; D168E; A219T; | + |
| 507/508 | T47R; A56S; E68A; V70I; H124R; V138L; A219T; | + |
| 509/510 | S42A; A56S; E68A; H97F; | + |
| 511/512 | A56S; E68A; A95V; A221C; | + |
| 513/514 | A56S; V70I; A95V; H124G; V138L; S144L; | + |
| 515/516 | A56S; A95V; H97F; | + |
| 517/518 | S35R; S42A; A56S; E68A; V70I; A95V; H97F; V157A; | + |
| 519/520 | T47R; A56S; E68A; A95V; H97F; D168E; A219T; A221C; | + |
| 521/522 | T47R; A56S; A95V; S144L; V157A; A221C; | + |
| 523/524 | S42A; A56S; A95V; H124R; V138L; A219T; | + |
| 525/526 | T47R; A56S; H97F; H124R; V138L; S144L; A219T; | + |
| 527/528 | S42A; T47R; A56S; E68A; A95V; V138L; A219T; | ++ |
| 529/530 | A56S; A95V; V138L; S144L; A221C; | ++ |
| 531/532 | T47R; A56S; V157A; A219T; | + |
| 533/534 | S35A; T47R; A56S; E68A; H97F; H124G; V138L; S144L; | + |
| 535/536 | S42A; T47R; A56S; E68A; H97F; H124G; S144L; V157A; A221C; | + |
| 537/538 | S42A; A56S; E68A; H124G; A219T; | + |
| 539/540 | A56S; E68A; A95V; V138L; A219T; A221C; | ++ |
| 541/542 | S35R; A56S; H124R; V138L; S144L; A219T; A221C; | + |
| 543/544 | S42A; A56S; E68A; V70I; H97F; D168E; A221C; | + |
| 545/546 | A56S; E68A; A221C; | + |
| 547/548 | A56S; A95V; V138L; A219T; A221C; | + |
| 549/550 | T47R; A56S; E68A; V70I; H124R; A219T; | + |
| 551/552 | A56S; E68A; V70I; H97F; H124R; V157A; A221C; | ++ |
| 553/554 | S35R; A56S; A95V; V157A; | + |
| 555/556 | A56S; H97F; | + |
| 557/558 | S42A; T47R; A56S; E68A; A221C; | + |
| 559/560 | A56S; A95V; H97F; V138L; | + |
| 561/562 | S35R; A56S; V138L; S144L; A221C; | + |
| 563/564 | S35R; A56S; E68A; H124R; S144L; A221C; | ++ |
| 565/566 | S35R; T47R; A56S; E68A; V70I; S144L; V157A; D168E; A219T; A221C; | + |
| 567/568 | S35R; T47R; A56S; A95V; H97F; H124R; V138L; A219T; A221C; | + |

Levels of increased activity were determined relative to the reference polypeptide of SEQ ID NO: 26 (i.e., engineered polypeptide having A56S) using Assay 5 and defined as follows:

"+" indicates at least 1.5-fold but less than 2.5-fold increased activity;

"++" indicates at least 2.5-fold but less than 4-fold increased activity;

"+++" indicates at least 4-fold increased activity.

TABLE 2D

| SEQ ID NO: (nt/aa) | Amino Acid Residue Difference(s) (relative to SEQ ID N0: 2) | Assay 8 (24 h, 65° C., 5M MDEA challenge/ 45° C., 1M MDEA pH 8.0 assay) |
|---|---|---|
| 569/570 | G2T; T30R; A40L; Q43M; A56S; V70I; A84Q; G120R; T139M; M170F; H222C; R223C; | + |
| 571/572 | G2T; T30R; Q32K; A40L; Q43M; A56S; A84Q; H97F; G120R; T139M; E200R; H222C; | + |
| 573/574 | G2T; T30R; R31P; A40L; Q43M; A56S; A84Q; G120R; T139M; E142L; H148T; M170F; H222C; | + |
| 575/576 | G2T; T30R; A40L; A56S; V70I; A84Q; H97F; G120R; T139M; E142L; H148T; E200R; H222C; R223C; | + |
| 577/578 | T30R; R31P; Q32R; A40L; A56S; A84Q; G120R; T139M; E142L; E200R; H222C; | + |
| 579/580 | T30R; A40L; Q43M; A56S; V70I; A84Q; D96E; G120R; T139M; M170F; H222C; | + |
| 581/582 | T30R; R31P; K37R; A40L; S42A; A56S; A60C; E68A; A84Q; Q119M; G120R; H124F; T139M; N213E; A219T; | + |
| 583/584 | T30R; Q32K; A40L; A56S; V70I; A84Q; D96E; G120R; A121T; T139M; E200R; | + |
| 585/586 | T30R; A40L; A56S; A84Q; G120R; A121L; T139M; H148T; E200R; R223C; | + |
| 587/588 | T30R; R31P; A40L; A56S; E68A; A84Q; G120R; T139M; N145W; N213E; | + |

TABLE 2D-continued

| SEQ ID NO: (nt/aa) | Amino Acid Residue Difference(s) (relative to SEQ ID N0: 2) | Assay 8 (24 h, 65° C., 5M MDEA challenge/ 45° C., 1M MDEA pH 8.0 assay) |
|---|---|---|
| 589/590 | T30R; R31P; A40L; A56S; A84Q; G120R; T139M; E142L; H148T; M170F; H222C; | + |
| 591/592 | T30R; R31P; A40L; A56S; V70I; A84Q; H97F; G120R; A121L; T139M; M170F; E200R; | + |
| 593/594 | T30R; R31P; A40L; A56S; A84Q; D96E; G120R; T139M; E142L; M170F; R223C; | + |
| 595/596 | T30R; R31P; A40L; A56S; A84Q; D96A; H97F; G120R; T139M; H148T; M170F; H222C; | + |
| 597/598 | T30R; K37R; A40L; S42A; A56S; E68A; A84Q; G120R; T139M; S144L; N145W; A219T; A221C; | + |
| 599/600 | T30R; A40L; A56S; A84Q; G120R; T139M; H148T; M170F; | + |
| 601/602 | T30R; R31P; A40L; A56S; A84Q; H97F; G120R; A121L; T139M; M170F; E200R; | + |
| 603/604 | T30R; R31P; A40L; A56S; A60C; A84Q; A95V; G120R; T139M; N145W; A219T; A221C; | + |
| 605/606 | T30R; Q32R; A40L; Q43M; A56S; V70I; A84Q; G120R; A121L; T139M; H148T; H222C; | + |
| 607/608 | T30R; K37R; A40L; A56S; A60C; E68A; A84Q; A95V; Q119M; G120R; T139M; A219T; | ++ |
| 609/610 | T30R; R31P; A40L; S42A; A56S; A84Q; G120R; H124R; T139M; S144L; | ++ |
| 611/612 | T30R; R31P; A40L; S42A; A56S; E68A; A84Q; G120R; H124F; T139M; S144L; N145F; A221C; | ++ |
| 613/614 | T30R; K37R; A40L; A56S; A60C; A84Q; Q119M; G120R; T139M; S144L; A219T; A221C; | ++ |
| 615/616 | T30R; A40L; S42A; A56S; A60C; E68A; A84Q; Q119M; G120R; T139M; N145W; | ++ |
| 617/618 | G2T; T30R; R31P; Q32K; A40L; Q43M; A56S; A84Q; G120R; T139M; H222C; | ++ |
| 619/620 | T30R; K37R; A40L; A56S; E68A; A84Q; G120R; H124R; T139M; V157A; | ++ |
| 621/622 | T30R; A40L; A56S; A84Q; Q119M; G120R; T139M; S144L; V157A; N213E; | ++ |
| 623/624 | T30R; Q32K; A40L; A56S; A84Q; G120R; T139M; E142L; H148T; M170F; E200R; R223C; | ++ |
| 625/626 | T30R; R31P; Q32K; A36T; A40L; A56S; V70I; A84Q; D96E; G120R; T139M; E142L; H148T; | ++ |
| 627/628 | T30R; A40L; A56S; A60C; A84Q; A95V; Q119M; G120R; T139M; V157A; N213E; A219T; | ++ |
| 629/630 | T30R; A40L; A56S; E68A; A84Q; G120R; T139M; S144L; N145W; V157A; N213E; | ++ |
| 631/632 | T30R; A40L; A56S; A60C; A84Q; Q119M; G120R; H124R; T139M; S144L; N145W; N213E; A221C; | ++ |
| 633/634 | T30R; R31P; A40L; A56S; A84Q; A95V; Q119M; G120R; H124R; T139M; S144L; N145W; V157A; A221C; | ++ |
| 635/636 | T30R; K37R; A40L; S42A; A56S; A60C; E68A; A84Q; Q119M; G120R; T139M; S144L; N145F; V157A; A221C; | ++ |
| 637/638 | T30R; R31P; A40L; S42A; A56S; A84Q; A95V; Q119M; G120R; H124R; T139M; A221C; | ++ |
| 639/640 | T30R; R31P; K37R; A40L; A56S; A60C; E68A; A84Q; A95V; G120R; H124F; T139M; S144L; N145F; N213E; A219T; | ++ |
| 641/642 | T30R; A40L; S42A; A56S; A84Q; A95V; Q119M; G120R; H124R; T139M; S144L; A221C; | ++ |
| 643/644 | G2T; T30R; R31P; Q32K; A40L; Q43M; A56S; A84Q; D96A; H97F; G120R; T139M; M170F; E200R; H222C; | ++ |
| 645/646 | T30R; A40L; A56S; E68A; A84Q; A95V; G120R; T139M; S144L; N145F; | ++ |
| 647/648 | T30R; A40L; Q43M; A56S; V70I; A84Q; G120R; A121L; T139M; M170F; R223C; | ++ |
| 649/650 | T30R; R31P; A40L; A56S; E68A; A84Q; A95V; Q119M; G120R; H124F; T139M; S144L; V157A; N213E; A221C; | ++ |
| 651/652 | G2T; T30R; R31P; A40L; Q43M; A56S; V70I; A84Q; G120R; T139M; E142L; H148T; M170F; E200R; H222C; | ++ |
| 653/654 | T30R; K37R; A40L; A56S; A60C; E68A; A84Q; A95V; G120R; H124R; T139M; N213E; A219T; A221C; | ++ |
| 655/656 | T30R; K37R; A40L; A56S; E68A; A84Q; A95V; Q119M; G120R; T139M; N145W; N213E; A219T; | ++ |
| 657/658 | T30R; A40L; A56S; A84Q; G120R; H124R; T139M; S144L; N145F; V157A; A219T; A221C; | ++ |
| 659/660 | T30R; K37R; A40L; S42A; A56S; A84Q; A95V; Q119M; G120R; H124R; T139M; S144L; V157A; N213E; A221C; | ++ |
| 661/662 | T30R; R31P; A40L; A56S; A84Q; A95V; G120R; T139M; S144L; N145F; V157A; A221C; | +++ |
| 663/664 | T30R; R31P; A40L; A56S; A84Q; A95V; G120R; H124R; T139M; S144L; N145F; A219T; A221C; | +++ |
| 665/666 | T30R; R31P; K37R; A40L; A56S; A60C; A84Q; A95V; Q119M; G120R; T139M; S144L; V157A; A219T; | +++ |

TABLE 2D-continued

| SEQ ID NO: (nt/aa) | Amino Acid Residue Difference(s) (relative to SEQ ID NO: 2) | Assay 8 (24 h, 65° C., 5M MDEA challenge/ 45° C., 1M MDEA pH 8.0 assay) |
|---|---|---|
| 667/668 | T30R; R31P; K37R; A40L; S42A; A56S; A60C; E68A; A84Q; A95V; Q119M; G120R; H124R; T139M; S144L; N145W; N213E; A219T; A221C; | +++ |
| 669/670 | T30R; A40L; A56S; A60C; E68A; A84Q; Q119M; G120R; H124R; T139M; S144L; N145F; V157A; | +++ |
| 671/672 | T30R; R31P; A40L; A56S; A60C; A84Q; A95V; Q119M; G120R; H124R; T139M; V157A; A221C; | +++ |
| 673/674 | T30R; R31P; K37R; A40L; A56S; E68A; A84Q; A95V; G120R; T139M; S144L; N145F; V157A; N213E; A221C; | +++ |
| 675/676 | G2T; T30R; R31P; A40L; Q43M; A56S; A84Q; H97F; G120R; T139M; M170F; E200R; | +++ |
| 677/678 | T30R; R31P; A40L; S42A; A56S; A60C; E68A; A84Q; A95V; Q119M; G120R; T139M; N145F; N213E; | +++ |

Levels of increased activity were determined relative to the reference polypeptide of SEQ ID NO: 332 (i.e., engineered polypeptide having T30R, A40L, A56S, A84Q, G120R, and T139M) using Assay 8 and defined as follows:
"+" indicates 1.5-fold but less than 1.7-fold increased activity;
"++" indicates at least 1.7-fold but less than 2.0-fold increased activity;
"+++" indicates at least 2.0-fold increased activity.

TABLE 2E

| SEQ ID NO: (nt/aa) | Amino Acid Residue Difference(s) (relative to SEQ ID NO: 2) | Assay 9 (24 h, 44° C., 5.6M NH$_3$ ($\alpha$ = 0.3) challenge/ 25° C., 0.28M NH$_3$ assay) | Assay 10 (24 h, RT, 5.6M NH$_3$ ($\alpha$ = 0.3) challenge/ 25° C., 0.28M NH$_3$ assay) |
|---|---|---|---|
| 679/680 | Q15R; T30R; H124G; K156L; | + | |
| 681/682 | Q15R; T30R; H97F; V131F; V157A; | + | |
| 683/684 | T4F; Q15R; T30R; Q32K; S35R; | + | |
| 685/686 | Q15R; T30R; V131F; K156L; V157A; A219T; | + | |
| 687/688 | Q15R; T30R; Q32K; S35A; A221C; | + | |
| 689/690 | Q15R; T30R; K143R; H148T; N213E; | + | |
| 691/692 | Q15R; T30R; L34H; A56S; A60C; A221C; R223Q; | + | |
| 693/694 | Q15R; T30R; L34H; Y93W; | + | |
| 695/696 | Q15R; T30R; D96E; H124G; K156L; A219T; | + | |
| 697/698 | Q15R; T30R; V70I; Y93W; | + | |
| 699/700 | Q15R; T30R; V131F; V157A; A219T; | + | |
| 701/702 | Q15R; T30R; V138W; | + | |
| 703/704 | Q15R; T30R; V157A; E200R; A219T; | + | |
| 705/706 | Q15R; A22G; T30R; L34H; V70I; Y93W; A95V; | + | |
| 707/708 | T4F; Q15R; T30R; L34H; A221C; | + | |
| 709/710 | T4F; Q15R; T30R; Q32R; L34H; S35R; A56S; A60C; R223C; | + | |
| 711/712 | G2R; Q15R; T30R; N213Q; A219T; | + | |
| 713/714 | Q15R; T30R; A95V; | + | |
| 715/716 | Q15R; T30R; H124G; H148T; N213Q; A219T; | + | |
| 717/718 | Q15R; T30R; D96E; H124G; H148T; K156L; A219T; | + | |
| 719/720 | G2R; Q15R; T30R; D96E; | + | |
| 721/722 | Q15R; A22G; T30R; A40Q; V70I; Y93W; A95V; | + | |
| 723/724 | Q15R; T30R; Q32R; L34H; S35A; | + | |
| 725/726 | Q15R; T30R; S35A; A60C; A221C; R223C; | + | |
| 727/728 | Q15R; T30R; L34H; S35A; A60V; A221C; | + | |
| 729/730 | Q15R; T30R; S35R; K156L; V157A; E200R; A219T; | + | |
| 731/732 | Q15R; T30R; K37R; A40L; Y93W; A95V; | + | |
| 733/734 | G2R; Q15R; T30R; H124G; K156L; A219T; | + | |
| 735/736 | G2R; Q15R; T30R; N213Q; | + | |
| 737/738 | Q15R; T30R; Q32K; L34H; S35A; A221C; R223C; | + | |
| 739/740 | Q15R; T30R; R31P; S35R; H97F; E159V; | + | |
| 741/742 | Q15R; T30R; D96E; T139H; N145C; H148T; K156L; A219T; | + | ++ |
| 743/744 | Q15R; T30R; V70I; Y93W; A121Q; | + | |
| 745/746 | G2R; Q15R; T30R; T139H; N145C; N213Q; A219T; | + | + |
| 747/748 | T4F; Q15R; T30R; A56S; A221C; | + | |
| 749/750 | Q15R; T30R; A56S; A60V; A221C; | ++ | |
| 751/752 | Q15R; A22G; T30R; H222C; | ++ | |
| 753/754 | Q15R; T30R; L34H; A60V; A84R; A221C; | ++ | |
| 755/756 | T4M; Q15R; T30R; A60V; | ++ | |
| 757/758 | Q15R; T30R; T139Q; K143R; K156L; N213Q; | ++ | |
| 759/760 | Q15R; T30R; V131L; K156L; E200R; | ++ | |

TABLE 2E-continued

| SEQ ID NO: (nt/aa) | Amino Acid Residue Difference(s) (relative to SEQ ID NO: 2) | Assay 9 (24 h, 44° C., 5.6M $NH_3$ ($\alpha$ = 0.3) challenge/ 25° C., 0.28M $NH_3$ assay) | Assay 10 (24 h, RT, 5.6M $NH_3$ ($\alpha$ = 0.3) challenge/ 25° C., 0.28M $NH_3$ assay) |
|---|---|---|---|
| 761/762 | T4F; Q15R; T30R; Q32K; L34H; A56S; A60V; A221C; | ++ | |
| 763/764 | Q15R; T30R; D96E; H124G; T139Q; K143R; K156L; | ++ | |
| 765/766 | T4F; Q15R; T30R; A60V; A221C; | ++ | |
| 767/768 | G2R; Q15R; T30R; H124G; K156L; | ++ | |
| 769/770 | T4M; Q15R; T30R; Q32K; A56S; A60C; A221C; R223C; | ++ | |
| 771/772 | T4M; Q15R; T30R; L34H; S35R; A60V; A221C; | ++ | |
| 773/774 | T4M; Q15R; T30R; S35A; A60C; A221C; | ++ | |
| 775/776 | G2R; Q15R; T30R; E142L; N213Q; A219T; | ++ | |
| 777/778 | T4F; Q15R; T30R; L34H; A56S; A84N; A221C; | ++ | |
| 779/780 | G2R; Q15R; T30R; D96E; N145C; N213E; | ++ | + |
| 781/782 | Q15R; T30R; T47R; H97F; V131L; K156L; E159V; E200R; A219T; | ++ | |
| 783/784 | Q15R; T30R; T47R; H97F; K156L; V157A; | ++ | |
| 785/786 | Q15R; T30R; H97F; K156L; V157A; E200R; A219T; | ++ | |
| 787/788 | Q15R; T30R; Q32K; A56S; A60V; A84Q; A221C; | ++ | |
| 789/790 | Q15R; T30R; S42A; K156L; V157A; A219T; | ++ | |
| 791/792 | Q15R; T30R; Q32R; S35R; A56S; | ++ | |
| 793/794 | G2R; Q15R; T30R; T47R; K156L; V157A; E200R; A219T; | ++ | |
| 795/796 | Q15R; T30R; Q32K; A56S; | ++ | |
| 797/798 | Q15R; T30R; R31P; V131L; V157A; A219T; | ++ | |
| 799/800 | Q15R; T30R; L34H; S35A; A56S; A221C; | ++ | |
| 801/802 | T4M; Q15R; T30R; Q32K; L34H; R223C; | ++ | |
| 803/804 | Q15R; T30R; R31P; S42A; K156L; | ++ | |
| 805/806 | G2R; Q15R; T30R; T139Q; N145C; K156L; A219T; | ++ | ++ |
| 807/808 | Q15R; T30R; Y93W; A95V; A121Q; H222C; | ++ | |
| 809/810 | Q15R; T30R; K37R; A40Q; | ++ | |
| 811/812 | Q15R; T30R; Q32K; S35A; A56S; A84N; A221C; | ++ | + |
| 813/814 | Q15R; A22G; T30R; L34H; A40L; | ++ | |
| 815/816 | Q15R; T30R; H97F; V131L; K156L; V157A; | ++ | |
| 817/818 | Q15R; T30R; D96E; H124G; T139Q; N145C; H148C; N213E; | ++ | |
| 819/820 | Q15R; T30R; A40W; E68G; H222C; | ++ | |
| 821/822 | Q15R; T30R; D96E; T139H; K143R; N145C; H148T; N213Q; | ++ | ++ |
| 823/824 | Q15R; T30R; Q32K; L34H; A56S; A84Q; | ++ | |
| 825/826 | Q15R; A22G; T30R; L34H; A40W; V70I; A121T; | ++ | |
| 827/828 | G2R; Q15R; T30R; D96E; E142L; N145C; N213Q; A219T; | ++ | + |
| 829/830 | Q15R; T30K; R31P; S42A; H97F; V131L; | ++ | |
| 831/832 | Q15R; T30R; A56S; A60C; | ++ | |
| 833/834 | Q15R; T30R; K37R; A40L; | ++ | |
| 835/836 | T4F; Q15R; T30R; A56S; A84N; A221C; R223C; | ++ | |
| 837/838 | Q15R; T30R; L34H; | ++ | |
| 839/840 | Q15R; A22G; T30R; A40L; H222C; | ++ | |
| 841/842 | G2R; Q15R; T30R; H124G; K156L; N213E; A219T; | ++ | |
| 843/844 | G2R; Q15R; T30R; D96E; K156L; N213E; | ++ | |
| 845/846 | Q15R; T30R; V70I; Y93W; A95V; H222C; | ++ | |
| 847/848 | G2R; Q15R; T30R; R31P; S42A; V131L; V157A; A219T; | ++ | |
| 849/850 | Q15R; T30R; V131L; K156L; V157A; | ++ | |
| 851/852 | G2R; Q15R; T30R; D96E; H124G; T139H; E142L; N213E; A219T; | ++ | |
| 853/854 | Q15R; T30R; A40Q; V138W; H222C; | ++ | |
| 855/856 | Q15R; T30R; L34H; E68A; V70I; | ++ | |
| 857/858 | Q15R; T30R; V70I; | ++ | |
| 859/860 | Q15R; T30R; L34H; A40L; | ++ | |
| 861/862 | Q15R; T30R; A56S; A221C; | ++ | |
| 863/864 | Q15R; T30R; Q32R; S35R; A84Q; R223Q; | ++ | |
| 865/866 | G2R; Q15R; T30R; D96E; H148C; K156L; N213Q; | ++ | + |
| 867/868 | Q15R; T30R; S35A; A84N; A221C; | ++ | |
| 869/870 | T4F; Q15R; T30R; Q32K; L34H; S35A; A56S; A60V; A84K; A221C; R223C; | ++ | |
| 871/872 | Q15R; T30R; V131L; V157A; E200R; | ++ | |
| 873/874 | Q15R; T30A; R31P; S35A; T47R; H97F; V131L; K156L; V157A; | +++ | |
| 875/876 | Q15R; T30R; A84R; A221C; R223C; | +++ | |
| 877/878 | Q15R; T30A; R31P; S35R; H97F; V131L; V157A; | +++ | |
| 879/880 | Q15R; T30R; H222C; | +++ | |
| 881/882 | Q15R; T30R; R31P; S35A; V131L; K156L; V157A; A219T; | +++ | |
| 883/884 | Q15R; T30R; L34H; K37C; | +++ | |
| 885/886 | Q15R; T30R; L34H; S35R; A84R; A221C; | +++ | |
| 887/888 | Q15R; T30R; L34H; K37R; | +++ | |
| 889/890 | T4M; Q15R; T30R; Q32K; S35R; A56S; R223Q; | +++ | |
| 891/892 | Q15R; T30R; Q32K; A56S; A60V; A84K; A221C; R223C; | +++ | |
| 893/894 | G2R; Q15R; T30R; T139Q; K143R; N145C; K156L; N213Q; | +++ | ++ |
| 895/896 | Q15R; T30R; A56S; | +++ | |
| 897/898 | Q15R; T30R; D96E; H124G; T139H; K143R; N145C; N213E; | +++ | ++ |

TABLE 2E-continued

| SEQ ID NO: (nt/aa) | Amino Acid Residue Difference(s) (relative to SEQ ID NO: 2) | Assay 9 (24 h, 44° C., 5.6M NH$_3$ ($\alpha$ = 0.3) challenge/ 25° C., 0.28M NH$_3$ assay) | Assay 10 (24 h, RT, 5.6M NH$_3$ ($\alpha$ = 0.3) challenge/ 25° C., 0.28M NH$_3$ assay) |
|---|---|---|---|
| 899/900 | Q15R; T30R; K37R; A40Q; E68V; H222C; | +++ | |
| 901/902 | Q15R; A22G; T30R; E68A; H222C; | +++ | |
| 903/904 | Q15R; L17X; T30R; A84N; R223C; | +++ | |
| 905/906 | T4M; Q15R; T30R; S35R; A56S; A84Q; | +++ | |
| 907/908 | Q15R; T30R; R31P; S35R; H97F; V131L; K156L; V157A; E159V; E200R; | +++ | |

TABLE 2F-continued

| SEQ ID NO: (nt/aa) | Amino Acid Residue Difference(s) (relative to SEQ ID NO: 2) | Assay 11 (24 h, 58° C., 8.4M NH$_3$ ($\alpha$ = 0.3) challenge/ 25° C., 1.37M NH$_3$ assay) |
|---|---|---|
| 987/988 | T4M; Q15R; T30R; Q32K; S35A; A56S; A84N; A95V; V131L; N145C; A221C; R223C; | + |
| 989/990 | Q15R; T30R; Q32K; S35A; A56S; A84N; A95V; H124G; V131L; N145C; N213E; A221C; R223C; | + |
| 991/992 | G2R; Q15R; T30R; Q32K; S35A; A56S; A84N; D96E; H97F; A121Q; H148T; K156L; A221C; | + |
| 993/994 | T4M; Q15R; T30R; Q32K; S35A; A56S; V70I; A84K; A95V; H124G; V131L; N145C; A221C; | + |
| 995/996 | Q15R; T30R; R31P; Q32K; S35A; K37R; A56S; A84N; D96E; H97F; V138F; K156L; A221C; | + |
| 997/998 | T4M; Q15R; T30R; Q32K; S35A; A56S; A84N; H124G; V131L; N145C; A221C; H222C; R223C; | + |
| 999/1000 | T4M; Q15R; T30R; Q32K; L34H; S35A; A56S; A84N; A95V; H124G; V131L; A221C; | + |
| 1001/1002 | G2R; Q15R; T30R; R31P; Q32K; S35A; K37C; A40L; A56S; A84N; D96E; H97F; K156L; A221C; | + |
| 1003/1004 | Q15R; T30R; R31P; Q32K; S35A; A56S; A84N; D96E; H97F; K156L; A221C; | + |
| 1005/1006 | Q15R; T30R; Q32K; S35A; A56S; A84N; D96E; A121Q; V138F; H148T; K156L; A221C; | + |
| 1007/1008 | Q15R; T30R; Q32K; L34H; S35A; A56S; V70I; A84R; V131L; T139Q; N145C; A221C; H222C; R223C; | + |
| 1009/1010 | G2R; Q15R; T30R; Q32K; S35A; A56S; A84N; D96E; H97F; A121K; V138W; H148T; K156L; A221C; | + |
| 1011/1012 | Q15R; T30R; Q32K; L34H; S35A; A56S; A84R; V131L; A221C; | + |
| 1013/1014 | Q15R; T30R; Q32K; L34H; S35A; A56S; A84Q; H124G; V131L; T139Q; N145C; N213Q; A221C; | + |
| 1015/1016 | T4M; Q15R; T30R; Q32K; L34H; S35A; A56S; V70I; A84Q; A95V; H124G; V131L; A221C; | + |
| 1017/1018 | Q15R; T30R; Q32K; S35A; A56S; A84K; A95V; V131L; N145C; V157A; N213Q; A221C; | + |
| 1019/1020 | Q15R; T30R; Q32K; L34H; S35A; A56S; A84Q; H124G; V131L; T139H; N213E; A221C; | + |
| 1021/1022 | Q15R; T30R; Q32K; S35A; A56S; A84K; A95V; V131L; A221C; | + |
| 1023/1024 | Q15R; T30R; Q32K; S35A; A56S; A84Q; A95V; V131L; N213E; A221C; | + |
| 1025/1026 | T4M; Q15R; T30R; Q32K; L34H; S35A; A56S; V70I; A84Q; A95V; H124G; V131L; T139Q; N145C; A221C; | + |
| 1027/1028 | T4M; Q15R; T30R; Q32K; S35A; A56S; A84Q; A95V; V131L; V157A; A221C; H222C; | + |
| 1029/1030 | Q15R; T30R; Q32K; S35A; A56S; A84K; A95V; H124G; V131L; T139Q; N213Q; A221C; H222C; R223C; | + |
| 1031/1032 | Q15R; T30R; Q32K; S35A; A56S; A84Q; A95V; H124G; V131L; A221C; | + |
| 1033/1034 | T4M; Q15R; T30R; Q32K; S35A; A56S; V70I; A84Q; A95V; V131L; T139Q; A221C; | + |
| 1035/1036 | Q15R; T30R; Q32K; S35A; A56S; A84Q; H124G; V131L; A221C; | + |
| 1037/1038 | T4M; Q15R; T30R; Q32K; L34H; S35A; A56S; V70I; A84R; A95V; H124G; V131L; V157A; N213E; A221C; H222C; R223C; | + |
| 1039/1040 | Q15R; T30R; Q32K; S35A; A56S; V70I; A84Q; V131L; T139H; N213Q; A221C; R223C; | + |
| 1041/1042 | T4M; Q15R; T30R; Q32K; S35A; A56S; V70I; A84K; V131L; T139Q; A221C; H222C; R223C; | + |
| 1043/1044 | T4M; Q15R; T30R; Q32K; S35A; A56S; A84Q; A95V; H124G; V131L; N213E; A221C; | + |
| 1045/1046 | T4M; Q15R; T30R; Q32K; L34H; S35A; A56S; A84Q; H124G; V131L; N145C; V157A; N213E; A221C; | + |
| 1047/1048 | Q15R; T30R; Q32K; S35A; A56S; A84Q; A95V; V131L; T139H; N145C; V157A; A221C; H222C; R223C; | + |
| 1049/1050 | T4M; Q15R; T30R; Q32K; S35A; A56S; A84Q; A95V; H124G; V131L; V157A; A221C; | + |
| 1051/1052 | T4M; Q15R; T30R; Q32K; L34H; S35A; A56S; A84K; A95V; H124G; V131L; N145C; A221C; H222C; R223C; | ++ |
| 1053/1054 | T4M; Q15R; T30R; Q32K; S35A; A56S; A84K; A95V; H124G; V131L; V157A; N213Q; A221C; H222C; R223C; | ++ |
| 1055/1056 | T4M; Q15R; T30R; Q32K; S35A; A56S; V70I; A84Q; A95V; V131L; T139Q; V157A; A221C; | ++ |

Levels of increased activity were determined relative to the reference polypeptide of SEQ ID NO: 812 (i.e., engineered polypeptide having Q15R, T30R, Q32K, S35A, A56S, A84N, and A221C) using Assay 11 and defined as follows:

"+" indicates 1.3-fold but less than 1.7-fold increased activity;

"++" indicates at least 1.7-fold but less than 2.0-fold increased activity;

"+++" indicates at least 2.0-fold increased activity.

TABLE 2G

| SEQ ID NO: (nt/aa) | Amino Acid Residue Difference(s) (relative to SEQ ID NO: 2) | Assay 12 (24 h/70° C./ 5M MDEA challenge/ 45° C. assay/0.5M MDEA) |
|---|---|---|
| 1057/1058 | T30R; R31P; K37R; A40L; A56S; E68A; A84Q; A95V; Q119M; G120R; T139M; N145W; N213E; A219T; | + |
| 1059/1060 | T30R; R31P; Q32R; K37R; A40L; A56S; E68A; A84Q; A95V; Q119M; G120R; H124R; T139M; N145F; E200R; N213E; A219T; | + |
| 1061/1062 | T30R; R31P; Q32R; K37R; A40L; A56S; A60C; E68A; A84Q; A95V; H97F; Q119M; G120R; T139M; N145W; N213E; A219T; A221C; H222C; | + |
| 1063/1064 | T30R; Q32R; K37R; A40L; Q43M; A56S; E68A; A84Q; A95V; H97F; Q119M; G120R; H124R; T139M; N145F; H148T; V157A; M170F; E200R; N213E; A219T; | + |
| 1065/1066 | T30R; R31P; K37R; A40L; Q43M; A56S; A60C; E68A; A84Q; A95V; Q119M; G120R; T139M; N145W; N213E; A219T; A221C; H222C; | + |
| 1067/1068 | T30R; Q32R; K37R; A40L; A56S; E68A; A84Q; A95V; Q119M; G120R; H124R; T139M; N145W; E200R; N213E; A219T; | + |
| 1069/1070 | T30R; K37R; A40L; S42A; Q43M; A56S; E68A; A84Q; A95V; Q119M; G120R; T139M; N145W; H148T; V157A; E200R; N213E; A219T; | + |
| 1071/1072 | T30R; R31P; K37R; A40L; Q43M; A56S; E68A; A84Q; A95V; D96A; H97F; Q119M; G120R; T139M; S144L; N145F; N213E; A219T; | + |
| 1073/1074 | T30R; R31P; Q32R; K37R; A40L; A56S; E68A; A84Q; A95V; H97F; Q119M; G120R; T139M; N145W; N213E; A219T; | + |
| 1075/1076 | T30R; Q32R; K37R; A40L; A56S; E68A; V70I; A84Q; A95V; D96E; Q119M; G120R; H124R; T139M; N145W; V157A; N213E; A219T; | + |
| 1077/1078 | T30R; K37R; A40L; A56S; A60C; E68A; A84Q; A95V; D96A; H97F; Q119M; G120R; H124F; T139M; N145W; H148T; M170F; N213E; A219T; | + |
| 1079/1080 | T30R; R31P; K37R; A40L; A56S; E68A; A84Q; A95V; Q119M; G120R; H124R; T139M; S144L; N145F; H148T; E200R; N213E; A219T; | + |
| 1081/1082 | T30R; R31P; K37R; A40L; A56S; E68A; A84Q; A95V; Q119M; G120R; H124R; T139M; S144L; N145F; H148T; V157A; M170F; E200R; N213E; A219T; | + |
| 1083/1084 | T30R; R31P; Q32R; K37R; A40L; A56S; E68A; V70I; A84Q; A95V; D96A; H97F; Q119M; G120R; T139M; N145W; N213E; A219T; | + |
| 1085/1086 | T30R; R31P; K37R; A40L; A56S; E68A; A84Q; A95V; Q119M; G120R; T139M; N145W; H148T; M170F; N213E; A219T; | + |
| 1087/1088 | T30R; Q32R; K37R; A40L; A56S; E68A; A84Q; A95V; D96A; H97F; Q119M; G120R; H124F; T139M; N145W; M170F; N213E; A219T; H222C; | + |
| 1089/1090 | T30R; R31P; K37R; A40L; Q43M; A56S; E68A; A84Q; A95V; Q119M; G120R; H124R; T139M; S144L; N145W; H148T; M170F; N213E; A219T; | + |
| 1091/1092 | T30R; Q32K; K37R; A40L; A56S; E68A; A84Q; A95V; D96E; Q119M; G120R; T139M; S144L; N145W; H148T; M170F; N213E; A219T; | + |
| 1093/1094 | T30R; K37R; A40L; A56S; E68A; A84Q; A95V; H97F; Q119M; G120R; T139M; N145W; M170F; N213E; A219T; H222C; | + |
| 1095/1096 | T30R; R31P; K37R; A40L; A56S; E68A; V70I; A84Q; A95V; Q119M; G120R; T139M; N145W; H148T; M170F; N213E; A219T; A221C; | ++ |
| 1097/1098 | T30R; K37R; A40L; A56S; E68A; A84Q; A95V; Q119M; G120R; H124R; T139M; N145F; M170F; E200R; N213E; A219T; | ++ |
| 1099/1100 | T30R; R31P; Q32R; K37R; A40L; S42A; Q43M; A56S; E68A; A84Q; A95V; Q119M; G120R; T139M; N145W; N213E; A219T; | ++ |
| 1101/1102 | T30R; K37R; A40L; A56S; E68A; V70I; A84Q; A95V; Q119M; G120R; H124R; T139M; N145F; V157A; N213E; A219T; | ++ |
| 1103/1104 | T30R; K37R; A40L; A56S; E68A; A84Q; A95V; D96A; H97F; Q119M; G120R; T139M; N145F; H148T; M170F; N213E; A219T; | ++ |
| 1105/1106 | T30R; K37R; A40L; S42A; A56S; E68A; A84Q; A95V; H97F; Q119M; G120R; H124R; T139M; S144L; N145W; H148T; N213E; A219T; | ++ |
| 1107/1108 | T30R; K37R; A40L; S42A; A56S; E68A; A84Q; A95V; Q119M; G120R; H124R; T139M; S144L; N145W; V157A; N213E; A219T; | ++ |
| 1109/1110 | T30R; R31P; K37R; A40L; A56S; E68A; V70I; A84Q; A95V; D96A; H97F; Q119M; G120R; T139M; N145W; N213E; A219T; A221C; H222C; | ++ |
| 1111/1112 | T30R; R31P; K37R; A40L; A56S; E68A; V70I; A84Q; A95V; Q119M; G120R; T139M; N145F; V157A; N213E; A219T; | ++ |
| 1113/1114 | T30R; R31P; K37R; A40L; A56S; E68A; A84Q; A95V; Q119M; G120R; T139M; N145F; H148T; V157A; M170F; N213E; A219T; | ++ |
| 1115/1116 | T30R; K37R; A40L; A56S; E68A; V70I; A84Q; A95V; H97F; Q119M; G120R; T139M; S144L; N145F; H148T; V157A; N213E; A219T; | ++ |
| 1117/1118 | T30R; R31P; K37R; A40L; S42A; A56S; E68A; V70I; A84Q; A95V; Q119M; G120R; H124R; T139M; N145F; H148T; V157A; M170F; N213E; A219T; | ++ |
| 1119/1120 | T30R; R31P; K37R; A40L; Q43M; A56S; A60C; E68A; A84Q; A95V; Q119M; G120R; T139M; N145W; N213E; A219T; H222C; | ++ |
| 1121/1122 | T30R; R31P; Q32K; K37R; A40L; A56S; E68A; A84Q; A95V; D96E; H97F; Q119M; G120R; T139M; N145W; E200R; N213E; A219T; | ++ |
| 1123/1124 | T30R; R31P; Q32K; K37R; A40L; A56S; E68A; V70I; A84Q; A95V; Q119M; G120R; H124R; T139M; S144L; N145W; V157A; N213E; A219T; | ++ |

TABLE 2G-continued

| SEQ ID NO: (nt/aa) | Amino Acid Residue Difference(s) (relative to SEQ ID NO: 2) | Assay 12 (24 h/70° C./ 5M MDEA challenge/ 45° C. assay/0.5M MDEA) |
|---|---|---|
| 1125/1126 | T30R; R31P; K37R; A40L; A56S; E68A; A84Q; A95V; D96A; H97F; Q119M; G120R; T139M; N145W; H148T; M170F; N213E; A219T; | ++ |
| 1127/1128 | T30R; K37R; A40L; A56S; E68A; V70I; A84Q; A95V; H97F; Q119M; G120R; H124R; T139M; N145F; H148T; V157A; M170F; E200R; N213E; A219T; | ++ |
| 1129/1130 | T30R; R31P; K37R; A40L; A56S; E68A; A84Q; A95V; D96E; Q119M; G120R; H124R; T139M; N145W; V157A; M170F; N213E; A219T; | ++ |
| 1131/1132 | T30R; R31P; K37R; A40L; A56S; E68A; A84Q; A95V; Q119M; G120R; T139M; S144L; N145F; V157A; N213E; A219T; | ++ |
| 1133/1134 | T30R; R31P; K37R; A40L; A56S; E68A; V70I; A84Q; A95V; H97F; Q119M; G120R; T139M; N145W; H148T; M170F; N213E; A219T; H222C; | ++ |
| 1135/1136 | T30R; K37R; A40L; Q43M; A56S; E68A; A84Q; A95V; H97F; Q119M; G120R; T139M; S144L; N145F; V157A; N213E; A219T; | ++ |
| 1137/1138 | T30R; K37R; A40L; S42A; A56S; E68A; A84Q; A95V; Q119M; G120R; T139M; S144L; N145W; H148T; V157A; M170F; E200R; N213E; A219T; | ++ |
| 1139/1140 | T30R; R31P; Q32K; K37R; A40L; A56S; E68A; A84Q; A95V; Q119M; G120R; H124R; T139M; S144L; N145F; H148T; V157A; M170F; N213E; A219T; | ++ |
| 1141/1142 | T30R; R31P; Q32K; K37R; A40L; A56S; E68A; A84Q; A95V; D96E; Q119M; G120R; H124R; T139M; N145F; V157A; M170F; N213E; A219T; | ++ |
| 1143/1144 | T30R; K37R; A40L; S42A; A56S; E68A; V70I; A84Q; A95V; Q119M; G120R; T139M; S144L; N145F; M170F; E200R; N213E; A219T; | ++ |
| 1145/1146 | T30R; R31P; K37R; A40L; A56S; E68A; A84Q; A95V; H97F; Q119M; G120R; H124R; T139M; N145W; V157A; N213E; A219T; | ++ |
| 1147/1148 | T30R; R31P; Q32K; K37R; A40L; S42A; Q43M; A56S; E68A; A84Q; A95V; Q119M; G120R; T139M; S144L; N145F; N213E; A219T; | ++ |
| 1149/1150 | T30R; R31P; Q32K; K37R; A40L; A56S; E68A; V70I; A84Q; A95V; Q119M; G120R; T139M; N145F; V157A; M170F; N213E; A219T; | +++ |
| 1151/1152 | T30R; R31P; K37R; A40L; Q43M; A56S; E68A; V70I; A84Q; A95V; Q119M; G120R; H124R; T139M; N145F; H148T; V157A; M170F; N213E; A219T; | +++ |
| 1153/1154 | T30R; K37R; A40L; A56S; E68A; A84Q; A95V; D96E; Q119M; G120R; H124R; T139M; S144L; N145F; N213E; A219T; | +++ |
| 1155/1156 | T30R; R31P; K37R; A40L; S42A; A56S; E68A; A84Q; A95V; D96A; H97F; Q119M; G120R; T139M; N145W; V157A; N213E; A219T; | +++ |
| 1157/1158 | T30R; R31P; K37R; A40L; A56S; E68A; A84Q; A95V; Q119M; G120R; H124R; T139M; N145W; V157A; M170F; N213E; A219T; | +++ |

Levels of increased activity were determined relative to the reference polypeptide of SEQ ID NO: 656 (i.e., engineered polypeptide having T30R; K37R; A40L; A56S; E68A; A84Q; A95V; Q119M; G120R; T139M; N145W; N213E; A219T) using Assay 12 and defined as follows:
"+" indicates at least 1.5-fold but less than 1.7-fold increased activity;
"++" indicates at least 1.7-fold but less than 2.0-fold increased activity;
"+++" indicates at least 2.0-fold increased activity.

TABLE 2H

| SEQ ID NO: (nt/aa) | Amino Acid Residue Difference(s) (relative to SEQ ID NO: 2) | Assay 13 (24 h/70° C./ 8.4M ammonia challenge/ RT assay) |
|---|---|---|
| 1159/1160 | T4M; Q15G; T30R; Q32K; S35A; A56S; V70I; A84Q; A95V; D96E; H97F; V131L; T139Q; K156L; V157A; A221C; | + |
| 1161/1162 | T4M; Q15G; T30R; Q32K; S35A; A56S; V70I; A84Q; A95V; H97F; A121Q; V131L; T139Q; H148T; V157A; N213E; A221C; | + |
| 1163/1164 | T4M; Q15R; T30R; Q32K; S35A; A56S; V70I; A84Q; A95V; V131L; T139Q; H148T; V157A; A221C; R223C; | + |
| 1165/1166 | G2R; T4M; Q15R; T30R; Q32K; S35A; A56S; V70I; A84Q; A95V; D96E; H97F; A121K; V131L; T139Q; V157A; N213E; A221C; | + |
| 1167/1168 | T4M; Q15G; T30R; Q32K; S35A; A56S; V70I; A84Q; A95V; H97F; V131L; T139Q; V157A; A221C; | + |
| 1169/1170 | G2R; T4M; Q15R; T30R; Q32K; S35A; A56S; V70I; A84Q; A95V; A121K; V131L; T139Q; V157A; N213E; A221C; | + |
| 1171/1172 | T4M; Q15R; T30R; Q32K; S35A; A56S; V70I; A84Q; A95V; V131L; T139Q; V157A; N213Q; A221C; | + |

Levels of increased activity were determined relative to the reference polypeptide of SEQ ID NO: 1056 (i.e., engineered polypeptide having T4M; Q15R; T30R; Q32K; S35A; A56S; V70I; A84Q; A95V; V131L; T139Q; V157A; A221C) using Assay 13 and defined as follows:

"+" indicates at least 1.3-fold;

TABLE 2I

| SEQ ID NO: (nt/aa) | Amino Acid Residue Difference(s) (relative to SEQ ID NO: 2) | Assay 14 (24 h/82.5° C./ 4.2M MDEA challenge/ 45° C. assay/960 mM MDEA) | Assay 15 (24 h/85° C./ 4.2M MDEA challenge/ 45° C. assay/960 mM MDEA) | Assay 16 (24 h/90° C./ 4.2M MDEA challenge/ 45° C. assay/960 mM MDEA) |
|---|---|---|---|---|
| 1173/1174 | T30R; R31P; A36L; K37R; A40L; Q43M; A56S; E68A; V70I; A84Q; A95V; Q119M; G120R; H124R; T139M; N145F; H148T; V157A; M170F; N213E; A219T; | + | | |
| 1175/1176 | T30R; R31P; K37R; A40L; Q43M; A56S; E68A; V70I; A84Q; A95V; Q119M; G120R; H124R; M129F; T139M; N145F; H148T; V157A; M170F; N213E; A219T; | + | | |
| 1177/1178 | T30R; R31P; K37R; A40L; Q43M; A56S; F66Y; E68A; V70I; A84Q; A95V; Q119M; G120R; H124R; T139M; N145F; H148T; V157A; M170F; N213E; A219T; | + | | |
| 1179/1180 | T30R; R31P; K37R; A40L; Q43M; A56S; E68A; V70I; A84Q; A95V; Q119M; G120R; V123K; H124R; T139M; N145F; H148T; V157A; M170F; N213E; A219T; | + | | |
| 1181/1182 | T30R; R31P; K37R; A40L; Q43M; A56S; E68A; V70I; A84Q; A95V; Q119M; G120R; H124R; T139M; N145F; H148K; V157A; M170F; N213E; A219T; | + | | |
| 1183/1184 | T30R; R31P; K37R; A40L; Q43M; A56S; E68A; V70I; A84Q; A95V; Q119M; G120R; H124R; M129Y; T139M; S144R; N145F; H148I; V157A; M170F; N213E; A219T; | +++ | +++ | +++ |
| 1185/1186 | T30R; R31P; K37R; A40L; Q43M; A56S; E68A; V70I; A84Q; A95V; Q119M; G120R; H124R; T139M; S144R; N145C; H148T; V157A; M170F; N213E; A219T; | ++ | +++ | + |
| 1187/1188 | T30R; R31P; K37R; A40L; Q43M; A56S; E68A; V70I; A84Q; A95V; Q119L; G120R; H124R; M129Y; T139M; N145C; H148T; V157A; M170F; N213E; A219T; | ++ | +++ | ++ |
| 1189/1190 | T30R; R31P; K37R; A40L; Q43M; A56S; E68A; V70I; A84Q; A95V; Q119M; G120R; H124R; M129F; T139M; N145C; H148T; V157A; M170F; N213E; A219T; | +++ | +++ | + |
| 1191/1192 | T30R; R31P; K37R; A40L; Q43M; A56S; E68A; V70I; A84Q; A95V; Q119M; G120R; H124R; M129Y; T139M; N145C; H148T; V157A; M170F; N213E; A219T; | ++ | +++ | |
| 1193/1194 | T30R; R31P; K37R; A40L; Q43M; A56S; E68A; V70I; A84Q; D86A; A95V; Q119M; G120R; H124R; T139M; S144R; N145F; H148T; V157A; M170F; N213E; A219T; | ++ | +++ | |
| 1195/1196 | T30R; R31P; K37R; A40L; Q43M; A56S; E68A; V70I; A84Q; A95V; Q119M; G120R; H124R; M129Y; T139M; S144R; N145F; H148K; V157A; M170F; N213E; A219T; | ++ | ++ | + |
| 1197/1198 | T30R; R31P; A36L; K37R; A40L; Q43M; A56S; E68A; V70I; A84Q; A95V; Q119M; G120R; H124R; T139M; N145C; H148K; V157A; M170F; N213E; A219T; | ++ | ++ | + |
| 1199/1200 | T30R; R31P; A36L; K37R; A40L; Q43M; A56S; E68A; V70I; A84Q; D86A; A95V; Q119M; G120R; H124R; T139M; S144R; N145F; H148T; V157A; M170F; N213E; A219T; | ++ | ++ | |
| 1201/1202 | T30R; R31P; A36L; K37R; A40L; Q43M; A56S; E68A; V70I; A84Q; A95V; Q119M; G120R; H124R; M129Y; T139M; N145C; H148I; V157A; M170F; N213E; A219T; | + | ++ | + |
| 1203/1204 | T30R; R31P; A36L; K37R; A40L; Q43M; A56S; E68A; V70I; A84Q; A95V; Q119M; G120R; V123K; H124R; T139M; N145C; H148T; V157A; M170F; N213E; A219T; | | ++ | ++ |
| 1205/1206 | T30R; R31P; K37R; A40L; Q43M; A56S; E68A; V70I; A84Q; D86A; A95V; Q119M; G120R; H124R; M129Y; T139M; N145F; H148T; V157A; M170F; N213E; A219T; | ++ | ++ | + |
| 1207/1208 | T30R; R31P; K37R; A40L; Q43M; H44L; A56S; E68A; V70I; A84Q; A95V; Q119L; G120R; H124R; M129Y; T139M; S144R; N145F; H148T; V157A; M170F; N213E; A219T; | ++ | ++ | ++ |

TABLE 2I-continued

| SEQ ID NO: (nt/aa) | Amino Acid Residue Difference(s) (relative to SEQ ID NO: 2) | Assay 14 (24 h/82.5° C./ 4.2M MDEA challenge/ 45° C. assay/960 mM MDEA) | Assay 15 (24 h/85° C./ 4.2M MDEA challenge/ 45° C. assay/960 mM MDEA) | Assay 16 (24 h/90° C./ 4.2M MDEA challenge/ 45° C. assay/960 mM MDEA) |
|---|---|---|---|---|
| 1209/1210 | T30R; R31P; K37R; A40L; Q43M; H44L; A56S; E68A; V70I; A84Q; A95V; Q119M; G120R; H124R; M129F; T139M; S144R; N145C; H148T; V157A; M170F; N213E; A219T; | ++ | ++ | +++ |
| 1211/1212 | T30R; R31P; K37R; A40L; Q43M; A56S; E68A; V70I; A84Q; D86A; A95V; Q119M; G120R; H124R; M129Y; T139M; N145C; H148T; V157A; M170F; N213E; A219T; | | ++ | + |
| 1213/1214 | T30R; R31P; K37R; A40L; Q43M; A56S; E68A; V70I; A84Q; A95V; Q119M; G120R; H124R; T139M; N145C; H148T; V157A; M170F; N213E; A219T; | ++ | ++ | |
| 1215/1216 | T30R; R31P; K37R; A40L; Q43M; A56S; E68A; V70I; A84Q; A95V; Q119M; G120R; H124R; M129Y; T139M; N145F; H148T; V157A; M170F; N213E; A219T; | ++ | ++ | |
| 1217/1218 | T30R; R31P; K37R; A40L; Q43M; A56S; E68A; V70I; A84Q; A95V; Q119L; G120R; H124R; T139M; S144R; N145C; H148I; V157A; M170F; N213E; A219T; | + | ++ | + |
| 1219/1220 | T30R; R31P; K37R; A40L; Q43M; A56S; E68A; V70I; A84Q; A95V; Q119M; G120R; H124R; M129Y; T139M; S144R; N145F; H148T; V157A; M170F; N213E; A219T; | + | ++ | |
| 1221/1222 | T30R; R31P; K37R; A40L; Q43M; A56S; E68A; V70I; A84Q; D86A; A95V; Q119L; G120R; H124R; T139M; S144R; N145F; H148I; V157A; M170F; N213E; A219T; | + | ++ | |
| 1223/1224 | T30R; R31P; K37R; A40L; Q43M; A56S; E68A; V70I; A84Q; D86A; A95V; Q119M; G120R; H124R; T139M; N145C; H148T; V157A; M170F; N213E; A219T; | + | ++ | + |
| 1225/1226 | T30R; R31P; K37R; A40L; Q43M; A56S; E68A; V70I; A84Q; A95V; Q119L; G120R; H124R; M129F; T139M; N145C; H148T; V157A; M170F; N213E; A219T; | ++ | ++ | + |
| 1227/1228 | T30R; R31P; K37R; A40L; Q43M; A56S; E68A; V70I; A84Q; D86A; A95V; Q119M; G120R; H124R; M129Y; T139M; N145F; H148K; V157A; M170F; N213E; A219T; | | ++ | |
| 1229/1230 | T30R; R31P; K37R; A40L; Q43M; A56S; E68A; V70I; A84Q; D86A; A95V; Q119M; G120R; H124R; T139M; N145F; H148T; V157A; M170F; N213E; A219T; | +++ | ++ | |
| 1231/1232 | T30R; R31P; K37R; A40L; Q43M; A56S; E68A; V70I; A84Q; D86A; A95V; Q119L; G120R; H124R; M129F; T139M; N145C; H148T; V157A; M170F; N213E; A219T; | | ++ | + |
| 1233/1234 | T30R; R31P; K37R; A40L; Q43M; A56S; E68A; V70I; A84Q; D86A; A95V; Q119M; G120R; H124R; M129F; T139M; N145F; H148T; V157A; M170F; N213E; A219T; | ++ | ++ | |
| 1235/1236 | T30R; R31P; K37R; A40L; Q43M; H44L; A56S; E68A; V70I; A84Q; D86A; A95V; Q119M; G120R; H124R; M129Y; T139M; S144R; N145F; H148T; V157A; M170F; N213E; A219T; | ++ | ++ | + |
| 1237/1238 | T30R; R31P; K37R; A40L; Q43M; A56S; E68A; V70I; A84Q; A95V; Q119L; G120R; H124R; T139M; S144R; N145F; H148I; V157A; M170F; N213E; A219T; | + | ++ | |
| 1239/1240 | T30R; R31P; A36L; K37R; A40L; Q43M; A56S; E68A; V70I; A84Q; A95V; Q119M; G120R; H124R; T139M; S144R; N145F; H148T; V157A; M170F; N213E; A219T; | + | ++ | |
| 1241/1242 | T30R; R31P; A36L; K37R; A40L; Q43M; A56S; E68A; V70I; A84Q; A95V; Q119L; G120R; H124R; M129Y; T139M; S144R; N145C; H148T; V157A; M170F; N213E; A219T; | | ++ | ++ |
| 1243/1244 | T30R; R31P; K37R; A40L; Q43M; H44L; A56S; E68A; V70I; A84Q; D86A; A95V; Q119L; G120R; H124R; M129Y; T139M; S144R; N145F; H148T; V157A; M170F; N213E; A219T; | | ++ | + |
| 1245/1246 | T30R; R31P; A36L; K37R; A40L; Q43M; A56S; E68A; V70I; A84Q; D86A; A95V; Q119M; G120R; V123K; H124R; M129F; T139M; N145C; H148I; V157A; M170F; N213E; A219T; | | ++ | ++ |

TABLE 2I-continued

| SEQ ID NO: (nt/aa) | Amino Acid Residue Difference(s) (relative to SEQ ID NO: 2) | Assay 14 (24 h/82.5° C./ 4.2M MDEA challenge/ 45° C. assay/960 mM MDEA) | Assay 15 (24 h/85° C./ 4.2M MDEA challenge/ 45° C. assay/960 mM MDEA) | Assay 16 (24 h/90° C./ 4.2M MDEA challenge/ 45° C. assay/960 mM MDEA) |
|---|---|---|---|---|
| 1247/1248 | T30R; R31P; A36L; K37R; A40L; Q43M; A56S; E68A; V70I; A84Q; A95V; Q119L; G120R; H124R; T139M; N145C; H148I; V157A; M170F; N213E; A219T; | | + | |
| 1249/1250 | T30R; R31P; K37R; A40L; Q43M; H44L; A56S; E68A; V70I; A84Q; A95V; Q119M; G120R; V123K; H124R; M129Y; T139M; N145F; H148K; V157A; M170F; N213E; A219T; | | + | ++ |
| 1251/1252 | T30R; R31P; K37R; A40L; Q43M; A56S; E68A; V70I; A84Q; A95V; Q119M; G120R; H124R; T139M; S144R; N145F; H148T; V157A; M170F; N213E; A219T; | + | + | + |
| 1253/1254 | T30R; R31P; K37R; A40L; Q43M; A56S; E68A; V70I; A84Q; D86A; A95V; Q119L; G120R; H124R; T139M; S144R; N145C; H148T; V157A; M170F; N213E; A219T; | | + | |
| 1255/1256 | T30R; R31P; K37R; A40L; Q43M; A56S; E68A; V70I; A84Q; D86A; A95V; Q119L; G120R; V123K; H124R; T139M; S144R; N145F; H148I; V157A; M170F; N213E; A219T; | | + | |
| 1257/1258 | T30R; R31P; K37R; A40L; Q43M; A56S; E68A; V70I; A84Q; A95V; Q119L; G120R; V123K; H124R; T139M; S144R; N145C; H148I; V157A; M170F; N213E; A219T; | | + | |
| 1259/1260 | T30R; R31P; K37R; A40L; Q43M; A56S; E68A; V70I; A84Q; A95V; Q119M; G120R; V123K; H124R; M129Y; T139M; N145C; H148T; V157A; M170F; N213E; A219T; | | + | |
| 1261/1262 | T30R; R31P; K37R; A40L; Q43M; A56S; E68A; V70I; A84Q; A95V; Q119L; G120R; V123K; H124R; M129F; T139M; S144R; N145C; H148I; V157A; M170F; N213E; A219T; | | + | |
| 1263/1264 | T30R; R31P; K37R; A40L; Q43M; H44L; A56S; E68A; V70I; A84Q; A95V; Q119L; G120R; V123K; H124R; T139M; N145C; H148T; V157A; M170F; N213E; A219T; | | + | ++ |
| 1265/1266 | T30R; R31P; K37R; A40L; Q43M; H44L; A56S; E68A; V70I; A84Q; A95V; Q119M; G120R; H124R; T139M; N145C; H148T; V157A; M170F; N213E; A219T; | | + | |
| 1267/1268 | T30R; R31P; K37R; A40L; Q43M; A56S; E68A; V70I; A84Q; D86A; A95V; Q119M; G120R; V123K; H124R; T139M; S144R; N145C; H148T; V157A; M170F; N213E; A219T; | | + | + |
| 1269/1270 | T30R; R31P; K37R; A40L; Q43M; H44L; A56S; E68A; V70I; A84Q; A95V; Q119L; G120R; V123K; H124R; M129F; T139M; S144R; N145C; H148T; V157A; M170F; N213E; A219T; | | + | + |

Levels of increased activity were determined relative to the reference polypeptide of SEQ ID NO: 1152 (i.e., engineered polypeptide having T30R; R31P; K37R; A40L; Q43M; A56S; E68A; V70I; A84Q; A95V; Q119M; G120R; H124R; T139M; N145F; H148T; V157A; M170F; N213E; A219T) and defined as "+", "++", or "+++" for each of the assays as follows:
Assay 14: "+" indicates at least 1.1-fold but less than 1.3-fold increased activity; "++" indicates at least 1.3-fold but less than 1.5-fold increased activity; "+++" indicates at least 1.5-fold increased activity.
Assay 15: "+" indicates at least 1.1-fold but less than 1.5-fold increased activity; "++" indicates at least 1.5-fold but less than 2-fold increased activity; "+++" indicates at least 2-fold increased activity.
Assay 16: "+" indicates at least 1.1-fold but less than 1.3-fold increased activity; "++" indicates at least 1.3-fold but less than 1.4-fold increased activity; "+++" indicates at least 1.4-fold increased activity.

TABLE 2J

| SEQ ID NO: (nt/aa) | Amino Acid Residue Difference(s) (relative to SEQ ID NO: 2) | Assay 17 (24 h/87° C./ 4.2M MDEA challenge/ 45° C. assay/685 mM MDEA) |
|---|---|---|
| 1271/1272 | T30R; R31P; K37R; A40L; Q43M; H44L; Y49F; I52V; A56S; E68Q; V70I; A84Q; A95V; Q119M; G120R; H124R; S126N; M129F; T139M; S144R; N145C; H148T; V157A; M170F; N213E; A219T; | ++ |

TABLE 2J-continued

| SEQ ID NO: (nt/aa) | Amino Acid Residue Difference(s) (relative to SEQ ID NO: 2) | Assay 17 (24 h/87° C./ 4.2M MDEA challenge/ 45° C. assay/685 mM MDEA) |
|---|---|---|
| 1273/1274 | T30R; R31P; K37R; A40L; Q43M; H44L; A56S; E68A; V70I; A84Q; A95V; D96E; Q119M; G120R; H124R; M129F; T139M; S144R; N145C; H148T; V157A; M170F; D196T; N213E; A219T; | + |
| 1275/1276 | T30R; R31P; K37R; A40L; Q43M; H44L; A56S; E68Q; V70I; A84Q; A95V; Q119M; G120R; H124R; S126N; M129F; T139M; S144R; N145C; H148T; V157A; M170F; N213E; A219T; | + |
| 1277/1278 | T30R; R31P; K37R; A40L; Q43M; H44L; Y49F; I52V; A56S; E68Q; V70I; I76V; A84Q; A95V; Q119M; G120R; H124R; S126N; M129F; T139M; S144R; N145C; H148T; V157A; M170F; N213E; A219T; | ++ |
| 1279/1280 | T30R; R31P; K37R; A40L; Q43M; H44L; I52V; A56S; E68A; V70I; A84Q; A95V; Q119M; G120R; H124R; S126N; M129F; T139M; S144R; N145C; H148T; V157A; M170F; N213E; A219T; | ++ |
| 1281/1282 | T30R; R31P; K37R; A40L; Q43M; H44L; A56S; E68A; V70I; A84Q; A95V; D96E; Q119M; G120R; H124R; M129F; T139M; S144R; N145C; H148T; V157A; M170F; N213E; A219T; | + |
| 1283/1284 | T30R; R31P; K37R; A40L; Q43M; H44L; Y49F; A56S; E68Q; V70I; A84Q; A95V; Q119M; G120R; H124R; S126N; M129F; T139M; S144R; N145C; H148T; V157A; M170F; N213E; A219T; | +++ |
| 1285/1286 | T30R; R31P; K37R; A40L; Q43M; H44L; Y49F; A56S; E68A; V70I; A84Q; A95V; Q119M; G120R; H124R; S126N; M129F; T139M; S144R; N145C; H148T; V157A; M170F; N213E; A219T; | ++ |

Levels of increased activity were determined relative to the reference polypeptide of SEQ ID NO: 1210 (i.e., engineered polypeptide having T30R; R31P; K37R; A40L; Q43M; H44L; A56S; E68A; V70I; A84Q; A95V; Q119M; G120R; H124R; M129F; T139M; S144R; N145C; H148T; V157A; M170F; N213E; A219T;) and defined as "+", "++", or "+++" for each of the assays as follows:
Assay 17: "+" indicates at least 1.1-fold but less than 1.3-fold increased activity; "++" indicates at least 1.3-fold but less than 1.5-fold increased activity; "+++" indicates at least 1.5-fold increased activity.

In addition to the exemplary polypeptides of Tables 2A, 2B, 2C, 2D, 2E, 2F, 2G, 2H, 2I, and 2J in some embodiments, the present disclosure provides a recombinant carbonic anhydrase polypeptide having an improved enzyme property relative to a polypeptide of SEQ ID NO:2, and an amino acid sequence having at least 80%, 85%, 86%, 87%, 88%, 89%, 90%, 91%, 92%, 93%, 94%, 95%, 96%, 97%, 98%, or 99% identity to a reference amino acid sequence selected from any one of which comprise an amino acid sequence selected from the polypeptide amino acid sequences disclosed in the accompanying Sequence Listing, specifically any one of the polypeptide amino acid sequences of SEQ ID NO: 4-1286 (which correspond to the even numbered sequence identifier numbers from 4 to 1286, inclusive).

In some embodiments, the disclosure provides a recombinant carbonic anhydrase an improved enzyme property relative to a reference polypeptide of SEQ ID NO:2, said recombinant polypeptide comprising an amino acid sequence having a feature selected from one or more: (a) having at least 93.7%, 94%, 95%, 96%, 97%, 98%, 99%, or 100% identity to SEQ ID NO:1152 or to a fragment of SEQ ID NO: 1152, wherein the fragment has at least 90%, 95%, 98%, or 99% of the length of SEQ ID NO: 1152; (b) having 14 or fewer, 13 or fewer, 12 or fewer, 11 or fewer, 10 or fewer, 9, 8, 7, 6, 5, 4, 3, 2, or 1 amino acid residue differences relative to SEQ ID NO: 1152; (c) having at least a combination of amino acid residue differences relative to SEQ ID NO: 2 present in any one of the polypeptide sequences of SEQ ID NO: 270-568, 570-678, 1058-1158, or 1174-1286; (d) having at least 93.7%, 94%, 95%, 96%, 97%, 98%, 99%, or 100% identity to SEQ ID NO:1162 or to a fragment of SEQ ID NO: 1162, wherein the fragment has at least 90%, 95%, 98%, or 99% of the length of SEQ ID NO: 1162; (e) having 14 or fewer, 13 or fewer, 12 or fewer, 11 or fewer, 10 or fewer, 9, 8, 7, 6, 5, 4, 3, 2, or 1 amino acid residue differences relative to SEQ ID NO: 1162; and (d) having at least a combination of amino acid residue differences relative to SEQ ID NO: 2 present in any one of the polypeptide sequences of SEQ ID NO: 680-1056, or 1160-1172.

Each of the exemplary recombinant carbonic anhydrase polypeptides shown in Tables 2A, 2B, 2C, 2D, 2E, 2F, 2G, 2H, 2I, and 2J comprises one or more amino acid residue differences as compared to SEQ ID NO: 2, and has at least 1.3-fold, at least 1.5-fold, at least 2-fold, at least 3-fold, or at least 5-fold increased stability relative to the polypeptide of SEQ ID NO: 2. Specific amino acid differences are shown in Tables 2A, 2B, 2C, 2D, 2E, 2F, 2G, 2H, 2I, and 2J and include one or more residue differences as compared to SEQ ID NO:2 at the following residue positions: X2; X4; X15; X16; X22; X30; X31; X32; X34; X35; X36; X37; X40; X42; X43; X44; X47; X49; X52; X56; X60; X66; X68; X70; X76; X84; X86; X93; X95; X96; X97; X119; X120; X121; X123; X124; X126; X129; X131; X138; X139; X142; X143; X144; X145; X147; X148; X156; X157; X159; X168; X170; X178; X196; X200; X207; X213; X219; X221; X222; and X223. Some of these positions appear in more than one polypeptide with different amino acid replacements. The specific amino acid residue differences found in the exemplary polypeptides having an improved property are: X2R; X2T; X4F; X4M; X15R; X16S; X22G; X30A; X30K; X30L; X30Q; X30R; X31P; X32K; X32R; X34H; X35A; X35R; X36L; X36T; X37C; X37R; X40L; X40Q; X40W; X42A; X43M; X43V; X44L; X47R; X49F; X52V; X56S; X60C; X60V; X66Y; X68A; X68G; X68Q; X68V; X70I; X76V; X84K; X84N; X84Q; X84R; X84S; X86A; X93W; X95V; X96A; X96C; X96E; X96K; X97F; X119K; X119L; X119M; X119T; X120R; X121H; X121K; X121L; X121Q; X121T; X121V; X121W; X123K; X124F; X124G; X124R; X126N; X129K; X129R; X131L; X131F; X138F; X138L; X138W; X139H; X139K; X139M; X139Q; X142L; X143M; X143R; X144A; X144L; X144R; X145C; X145F; X145L; X145W; X147E; X147F; X147G; X147T; X148A; X148C; X148K; X148T; X156L; X157A;

X159H; X159R; X159V; X168E; X170F; X178G; X196T; X200R; X207E; X207N; X213E; X213Q; X219T; X221C; X222C; X223C; and X223Q.

It will be apparent to the skilled artisan that the residue positions and specific residue differences of the present disclosure which have been shown to improve stability in solutions comprising amine compounds and/or ammonia can be used to generate recombinant carbonic anhydrase polypeptides besides the exemplary polypeptides of Tables 2A, 2B, 2C, 2D, 2E, 2F, 2G, 2H, 2I, and 2J. It is contemplated that additional recombinant carbonic anhydrase polypeptides having improved properties can be prepared comprising various combinations of the amino acid residue differences of the exemplary polypeptides of Tables 2A, 2B, 2C, 2D, 2E, 2F, 2G, 2H, 2I, and 2J. This has been demonstrated by the recombinant carbonic anhydrase polypeptides of Tables 2B and 2C, which have improved stability in the presence of an amine compound, were prepared by combining the single amino acid difference of SEQ ID NO: 26 (i.e., X56S) with various other amino acid differences from Table 2A to create the improved polypeptides of even-numbered SEQ ID NO: 188-568.

Similarly, the recombinant carbonic anhydrase polypeptides of Table 2D, which have increased stability in the presence of an amine compound relative to the polypeptides of Tables 2B and 2C, were prepared by combining the combination of amino acid differences of SEQ ID NO: 332 (i.e., X30R, X40L, X56S, X84Q, X120R, and X139M) with various other amino acid differences disclosed herein to create the improved polypeptides of even-numbered SEQ ID NO: 570-678; the recombinant carbonic anhydrase polypeptides of Table 2G, which have increased stability in the presence of an amine compound relative to the polypeptides of Table 2D, were prepared by combining the combination of amino acid differences of SEQ ID NO: 656 (i.e., T30R; K37R; A40L; A56S; E68A; A84Q; A95V; Q119M; G120R; T139M; N145W; N213E; A219T) with various other amino acid differences disclosed herein to create the improved polypeptides of even-numbered SEQ ID NO: 1058-1158; the recombinant carbonic anhydrase polypeptides of Table 2I, which have increased stability in the presence of an amine compound relative to the polypeptides of Table 2G, were prepared by combining the combination of amino acid differences of SEQ ID NO: 1152 (i.e., T30R; R31P; K37R; A40L; Q43M; A56S; E68A; V70I; A84Q; A95V; Q119M; G120R; H124R; T139M; N145F; H148T; V157A; M170F; N213E; A219T) with various other amino acid differences disclosed herein to create the improved polypeptides of even-numbered SEQ ID NO: 1174-1270; the recombinant carbonic anhydrase polypeptides of Table 2J, which have increased stability in the presence of an amine compound relative to the polypeptides of Table 2I, were prepared by combining the combination of amino acid differences of SEQ ID NO: 1210 (i.e., T30R; R31P; K37R; A40L; Q43M; H44L; A56S; E68A; V70I; A84Q; A95V; Q119M; G120R; H124R; M129F; T139M; S144R; N145C; H148T; V157A; M170F; N213E; A219T) with various other amino acid differences disclosed herein to create the improved polypeptides of even-numbered SEQ ID NO: 1272-1286.

The recombinant carbonic anhydrase polypeptides of Table 2E, which have increased stability in the presence of ammonia relative to the polypeptides of Table 2A, were prepared by combining the combination of amino acid differences of SEQ ID NO: 32 (i.e., Q15R and T30R) with various other amino acid differences disclosed herein to create the improved polypeptides of even-numbered SEQ ID NO: 680-972; the recombinant carbonic anhydrase polypeptides of Table 2F, which have increased stability in the presence of ammonia relative to the polypeptides of Table 2E, were prepared by combining the combination of amino acid differences of SEQ ID NO: 812 (i.e., Q15R, T30R, Q32K, S35A, A56S, A84N, and A221C) with various other amino acid differences disclosed herein to create the improved polypeptides of even-numbered SEQ ID NO: 974-1056; and the recombinant carbonic anhydrase polypeptides of Table 2H, which have increased stability in the presence of ammonia relative to the polypeptides of Table 2F, were prepared by combining the combination of amino acid differences of SEQ ID NO: 1056 (i.e., T4M; Q15R; T30R; Q32K; S35A; A56S; V70I; A84Q; A95V; V131L; T139Q; V157A; A221C) with various other amino acid differences disclosed herein to create the improved polypeptides of even-numbered SEQ ID NO: 1160-1172.

Accordingly, in some embodiments, the present disclosure provides a recombinant carbonic anhydrase polypeptide having at least 1.3-fold, at least 1.5-fold, at least 2-fold, at least 3-fold, or at least 5-fold increased stability relative to the polypeptide of SEQ ID NO: 2, comprises an amino acid sequence having at least 80%, 85%, 86%, 87%, 88%, 89%, 90%, 91%, 92%, 93%, 94%, 95%, 96%, 97%, 98%, or 99% identity to SEQ ID NO: 2, and further comprises the one or more amino acid residue differences as compared to SEQ ID NO:2 of any one of amino acid sequences of the even-numbered SEQ ID NO: 4-1286. In some embodiments, in addition to the set of amino acid residue differences of any one of the recombinant carbonic anhydrase polypeptides comprising an amino acid sequence of even-number SEQ ID NO: 4-1286, the sequence of the recombinant polypeptide can further comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40 residue differences at other amino acid residue positions as compared to the SEQ ID NO: 2. In some embodiments, the residue differences can comprise conservative substitutions and/or non-conservative substitutions as compared to SEQ ID NO: 2.

In some embodiments, any of the recombinant carbonic anhydrase polypeptides having an improved property relative to the polypeptide of SEQ ID NO: 2 and an amino acid sequence having at least 80%, 85%, 86%, 87%, 88%, 89%, 90%, 91%, 92%, 93%, 94%, 95%, 96%, 97%, 98%, or 99% identity to SEQ ID NO: 2 and one or more of the following amino acid residue differences relative to SEQ ID NO: 2: X2R; X2T; X4F; X4M; X15R; X16S; X22G; X30A; X30K; X30L; X30Q; X30R; X31P; X32K; X32R; X34H; X35A; X35R; X36L; X36T; X37C; X37R; X40L; X40Q; X40W; X42A; X43M; X43V; X44L; X47R; X49F; X52V; X56S; X60C; X60V; X66Y; X68A; X68G; X68Q; X68V; X70I; X76V; X84K; X84N; X84Q; X84R; X84S; X86A; X93W; X95V; X96A; X96C; X96E; X96K; X97F; X119K; X119L; X119M; X119T; X120R; X121H; X121K; X121L; X121Q; X121T; X121V; X121W; X123K; X124F; X124G; X124R; X126N; X129K; X129R; X131L; X131F; X138F; X138L; X138W; X139H; X139K; X139M; X139Q; X142L; X143M; X143R; X144A; X144L; X144R; X145C; X145F; X145L; X145W; X147E; X147F; X147G; X147T; X148A; X148C; X148K; X148T; X156L; X157A; X159H; X159R; X159V; X168E; X170F; X178G; X196T; X200R; X207E; X207N; X213E; X213Q; X219T; X221C; X222C; X223C; and X223Q.

The positions associated with the improved property of increased stability in the presence of an amine compound include: X2; X4; X15; X16; X30; X31; X32; X34; X35; X36; X37; X40; X42; X43; X44; X47; X49; X52; X56; X60; X66; X68; X70; X76; X84; X86; X95; X96; X97; X119; X120;

X121; X123; X124; X126; X129; X131; X138; X139; X142; X144; X145; X147; X148; X159; X168; X170; X178; X196; X200; X213; X219; X221; X222; and X223. The specific amino acid residue differences associated with the improved property of increased stability in the presence of an amine compound include: X2R; X2T; X4F; X4M; X15R; X16S; X30A; X30K; X30L; X30Q; X30R; X31P; X32K; X32R; X34H; X35A; X35R; X36L; X36T; X37R; X40L; X40W; X42A; X43M; X43V; X44L; X47R; X49F; X52V; X56S; X60C; X68A; X68G; X68Q; X70I; X76V; X84N; X84Q; X84R; X84S; X86A; X95V; X96A; X96C; X96E; X96K; X97F; X119K; X119L; X119M; X119T; X120R; X121H; X121K; X121L; X121Q; X121T; X121V; X121W; X123K; X124F; X124G; X124R; X126N; X131F; X131L; X138L; X139H; X139K; X139M; X139Q; X142L; X144A; X144L; X144R; X145C; X145F; X145L; X145W; X147E; X147F; X147G; X147T; X148A; X148T; X159H; X159R; X159V; X168E; X170F; X178G; X196T; X200R; X213E; X213Q; X219T; X221C; X222C; and X223C.

In some embodiments, the present disclosure provides a recombinant carbonic anhydrase polypeptide in which the increased stability in the presence of an amine compound comprises at least 1.3-fold increased activity relative to the reference polypeptide of SEQ ID NO: 2 after 24 hours exposure to 4 M MDEA at 42° C. and the amino acid sequence comprises one or more of the following amino acid residue differences relative to SEQ ID NO: 2: X2R; X2T; X4F; X4M; X15R; X16S; X30A; X30K; X30L; X30Q; X30R; X31P; X32K; X32R; X34H; X35A; X35R; X36L; X36T; X37R; X40L; X40W; X42A; X43M; X43V; X44L; X47R; X49F; X52V; X56S; X60C; X68A; X68G; X68Q; X70I; X76V; X84N; X84Q; X84R; X84S; X86A; X95V; X96A; X96C; X96E; X96K; X97F; X119K; X119L; X119M; X119T; X120R; X121H; X121K; X121L; X121Q; X121T; X121V; X121W; X123K; X124F; X124G; X124R; X126N; X131F; X131L; X138L; X139H; X139K; X139M; X139Q; X142L; X144A; X144L; X144R; X145C; X145F; X145L; X145W; X147E; X147F; X147G; X147T; X148A; X148T; X159H; X159R; X159V; X168E; X170F; X178G; X196T; X200R; X213E; X213Q; X219T; X221C; X222C; and X223C.

In some embodiments, the present disclosure provides a recombinant carbonic anhydrase polypeptide in which the increased stability in the presence of an amine compound comprises at least 1.5-fold increased activity relative to the reference polypeptide of SEQ ID NO: 2 after 24 hours exposure to 4 M MDEA at 50° C. and the amino acid sequence comprises one or more of the following amino acid residue differences relative to SEQ ID NO: 2: X2T; X4F; X31P; X40L; X56S; X84Q; X119M; X120R; X121K; X121W; X131L; X139M; X147E; X147T; and X170F.

In some embodiments, the present disclosure provides a recombinant carbonic anhydrase polypeptide in which the increased stability in the presence of an amine compound comprises at least 2-fold increased activity relative to the reference polypeptide of SEQ ID NO: 2 after 24 hours exposure to 4 M MDEA at 50° C. and the amino acid sequence comprises one or more of the following amino acid residue differences relative to SEQ ID NO: 2: X2T; X56S; X84Q; X139M; X147E; and X147T.

In some embodiments, the present disclosure provides a recombinant carbonic anhydrase polypeptide in which the increased stability in the presence of an amine compound in which the increased stability in the presence of an amine compound comprises at least 3-fold increased activity relative to the reference polypeptide of SEQ ID NO: 2 after 24 hours exposure to 4 M MDEA at 50° C. and an amino acid sequence comprising one or more of the following amino acid residue differences relative to SEQ ID NO: 2: X56S; X84Q; X147E and X147T.

In some embodiments, the present disclosure provides a recombinant carbonic anhydrase polypeptide in which the improved enzyme property is increased stability in the presence of an amine compound and in which the amino acid sequence comprises the amino acid difference X56S and one or more of the following amino acid residue differences relative to SEQ ID NO: 2: X2R; X2T; X4F; X4M; X15R; X16S; X30A; X30K; X30L; X30Q; X30R; X31P; X32K; X32R; X34H; X35A; X35R; X36L; X36T; X37R; X40L; X40W; X42A; X43M; X43V; X44L; X47R; X49F; X52V; X60C; X68A; X68G; X68Q; X70I; X76V; X84N; X84Q; X84R; X84S; X86A; X95V; X96A; X96C; X96E; X96K; X97F; X119K; X119L; X119M; X119T; X120R; X121H; X121K; X121L; X121Q; X121T; X121V; X121W; X123K; X124F; X124G; X124R; X126N; X131F; X131L; X138L; X139H; X139K; X139M; X139Q; X142L; X144A; X144L; X144R; X145C; X145F; X145L; X145W; X147E; X147F; X147G; X147T; X148A; X148T; X159H; X159R; X159V; X168E; X170F; X178G; X196T; X200R; X213E; X213Q; X219T; X221C; X222C; and X223C.

In some embodiments, the present disclosure provides a recombinant carbonic anhydrase polypeptide in which the improved enzyme property is increased stability in the presence of an amine compound characterized by at least 1.5-fold increased activity relative to the reference polypeptide of SEQ ID NO: 332 after 24 hours exposure to 5 M MDEA at 65° C. In some embodiments, the amino acid sequence of the recombinant carbonic anhydrase polypeptide having increased stability in the presence of an amine compound comprises at least the following amino acid residue differences relative to SEQ ID NO: 2: X30R, X40L, X56S, X84Q, X120R, and X139M. In some embodiments, the amino acid sequence comprises at least a combination of amino acid residue differences relative to SEQ ID NO: 2 present in any one of the polypeptide sequences of SEQ ID NO: 570-678, 1058-1158, or 1174-1286. In some embodiments, the amino acid sequence comprises any one of the polypeptide sequences of SEQ ID NO: 570-678, 1058-1158, or 1174-1286.

In some embodiments, the present disclosure provides a recombinant carbonic anhydrase polypeptide in which the improved enzyme property is increased stability in the presence of an amine compound characterized by at least 1.5-fold increased activity relative to the reference polypeptide of SEQ ID NO: 656 after 24 hours exposure to 5 M MDEA at 70° C. In some embodiments, the amino acid sequence of the recombinant carbonic anhydrase polypeptide having increased stability in the presence of an amine compound comprises at least the amino acid residue differences relative to SEQ ID NO: 2: X30R, X37R, X40L, X56S, X68A, X84Q, X95V, X119M, X120R, X139M, X145W; X213E, and X219T. In some embodiments, the amino acid sequence comprises at least a combination of amino acid residue differences relative to SEQ ID NO: 2 present in any one of the polypeptide sequences of SEQ ID NO: 1058-1158, or 1174-1286. In some embodiments, the amino acid sequence comprises any one of the polypeptide sequences of SEQ ID NO: 1058-1158, or 1174-1286.

In some embodiments, the present disclosure provides a recombinant carbonic anhydrase polypeptide in which the improved enzyme property is increased stability in the presence of an amine compound characterized by retaining at least about 30%, at least about 40%, at least about 50%, at least about 60%, at least about 70%, at least about 80%, at least about 90%, or at least about 95% or greater residual activity after exposure to a solution comprising at least 4.2 M MDEA at 50° C. for period of at least about 1, 4, 7, 12, or 14 days. In some embodiments, the amino acid sequence of the recombinant carbonic anhydrase polypeptide having increased stability characterized by retention of at least 30% residual activity after exposure to a solution comprising about 4.2 M MDEA at 50° C. for at least about 14 days comprises at least the amino acid residue differences relative to SEQ ID NO: 2: X30R; X31P; X37R; X40L; X43M; X56S; X68A; X70I; X84Q; X95V; X119M; X120R; X124R; X139M; X144R; X145F; X148T; X157A; X170F; X213E; and X219T. In some embodiments, the amino acid sequence further comprises at least 2, at least 3, at least 4, or at least 5 lysine (K) residues and/or arginine (R) residues substituted at positions X121-X126 and/or at positions X144-X149 relative to SEQ ID NO: 2. In some embodiments, the at least 2, at least 3, at least 4, or at least 5 lysine (K) residue and/or arginine (R) residue substitutions are selected from: X84K, X84R, X120R, X121K, X123K, X124R, X129K, X129R, X139K, X143R, X144R, and X148K. In some embodiments, the at least 2, at least 3, at least 4, or at least 5 lysine (K) residues and/or arginine (R) residues substitutions are selected from: X84K, X123K, X124R, X129K, X129R, X143R, X144R, and X148K. In some embodiments, the amino acid sequence comprises at least a combination of amino acid residue differences relative to SEQ ID NO: 2 present in any one of the polypeptide sequences of SEQ ID NO: 1058-1158, or 1174-1286. In some embodiments, the amino acid sequence comprises any one of the polypeptide sequences of SEQ ID NO: 1058-1158, or 1174-1286.

The positions associated with the improved property of increased stability in the presence of an ammonia include: X2; X4; X15; X22; X30; X32; X34; X35; X37; X40; X42; X47; X56; X60; X68; X70; X84; X86; X93; X95; X96; X121; X124; X138; X143; X156; X157; X170; X207; X219; X221; X222; and X223. The specific amino acid residue differences associated with the improved property of increased stability in the presence of ammonia include: X2R; X4F; X4M; X15R; X22G; X30A; X30K; X30L; X30Q; X30R; X32K; X32R; X34H; X35A; X35R; X37C; X37R; X40L; X40Q; X40W; X42A; X47R; X56S; X60C; X60V; X68A; X68G; X68V; X70I; X84K; X84Q; X86A; X93W; X95V; X96E; X121H; X121K; X121Q; X121T; X121W; X124G; X131F; X138F; X138W; X143M; X143R; X148C; X156L; 157A; X170F; X207E; X207N; X219T; X221C; X222C; and X223Q.

In some embodiments, the present disclosure provides a recombinant carbonic anhydrase polypeptide in which the increased stability in the presence of ammonia comprises at least 1.3-fold increased activity relative to the reference polypeptide of SEQ ID NO: 2 after 24 hours exposure to ammonia at 35° C. and the amino acid sequence comprises one or more of the following amino acid residue differences relative to SEQ ID NO: 2: X2R; X4F; X22G; X30A; X30L; X30Q; X30R; X32K; X32R; X34H; X35A; X35R; X37R; X40Q; X40W; X56S; X60C; X60V; X68A; X68G; X70I; X84K; X84Q; X86A; X95V; X121Q; X121T; X121W; X157A; X221C; X222C; and X223Q.

In some embodiments, the present disclosure provides a recombinant carbonic anhydrase polypeptide in which the increased stability in the presence of ammonia comprises at least 3-fold increased activity relative to the reference polypeptide of SEQ ID NO: 2 after 24 hours exposure to ammonia at 35° C. and the amino acid sequence comprises one or more of the following amino acid residue differences relative to SEQ ID NO: 2: X4F; X22G; X30A; X30Q; X30R; X32K; X34H; X35A; X37R; X56S; X60C; X60V; X70I; X84Q; X121W; X221C; X222C; and X223Q.

In some embodiments, the present disclosure provides a recombinant carbonic anhydrase polypeptide having increased stability in the presence of ammonia in which the amino acid sequence comprises one or more of the amino acid residue differences selected from X15R and X30R, and further comprises one or more of the following amino acid residue differences relative to SEQ ID NO: 2: X2R; X4F; X4M; X22G; X30A; X30K; X30L; X30Q; X32K; X32R; X34H; X35A; X35R; X37C; X37R; X40L; X40Q; X40W; X42A; X47R; X56S; X60C; X60V; X68A; X68G; X68V; X70I; X84K; X84Q; X86A; X93W; X95V; X96E; X121H; X121K; X121Q; X121T; X121W; X124G; X131F; X138F; X138W; X143M; X143R; X148C; X156L; 157A; X170F; X207E; X207N; X219T; X221C; X222C; and X223Q. In some embodiments, the amino acid sequence comprises both X15R and X30R and further comprises one or more of the following amino acid residue differences relative to SEQ ID NO: 2: X2R; X4F; X4M; X22G; X32K; X32R; X34H; X35A; X35R; X37C; X37R; X40L; X40Q; X40W; X42A; X47R; X56S; X60C; X60V; X68A; X68G; X68V; X70I; X84K; X84Q; X86A; X93W; X95V; X96E; X121H; X121K; X121Q; X121T; X121W; X124G; X131F; X138F; X138W; X143M; X143R; X148C; X156L; 157A; X170F; X207E; X207N; X219T; X221C; X222C; and X223Q.

In some embodiments, the present disclosure provides a recombinant carbonic anhydrase polypeptide in which the improved enzyme property is increased stability in the presence of ammonia characterized by at least 1.5-fold increased activity relative to the reference polypeptide of SEQ ID NO: 32 after 24 hours exposure to 5.6 M $NH_3$ at 44° C. In some embodiments, the amino acid sequence of the recombinant carbonic anhydrase polypeptide having increased stability in the presence of ammonia comprises at least the amino acid residue differences relative to SEQ ID NO: 2: X15R, and X30R. In some embodiments, the amino acid sequence comprises at least a combination of amino acid residue differences relative to SEQ ID NO: 2 present in any one of the polypeptide sequences of SEQ ID NO: 680-1056, or 1160-1172. In some embodiments, the amino acid sequence comprises any one of the polypeptide sequences of SEQ ID NO: 680-1056, or 1160-1172.

In some embodiments, the present disclosure provides a recombinant carbonic anhydrase polypeptide in which the improved enzyme property is increased stability in the presence of ammonia characterized by at least 1.3-fold increased activity relative to the reference polypeptide of SEQ ID NO: 812 after 24 hours exposure to 8.4 M $NH_3$ at 58° C. In some embodiments, the amino acid sequence of the recombinant carbonic anhydrase polypeptide having increased stability in the presence of ammonia comprises at least the amino acid residue differences relative to SEQ ID NO: 2: X15R, X30R, X32K, X35A, X56S, X84N, and X221C. In some embodiments, the amino acid sequence comprises at least a combination of amino acid residue differences relative to SEQ ID NO: 2 present in any one of the polypeptide sequences of SEQ ID NO: 974-1056, or 1160-1172. In some embodiments, the amino acid sequence comprises any one of the polypeptide sequences of SEQ ID NO: 974-1056, or 1160-1172.

In some embodiments, the present disclosure provides a recombinant carbonic anhydrase polypeptide in which the improved enzyme property is increased stability in the presence of ammonia characterized by at least 1.3-fold increased activity relative to the reference polypeptide of SEQ ID NO: 1056 after 24 hours exposure to 8.4 M $NH_3$ at 70° C. In some embodiments, the amino acid sequence of the recombinant carbonic anhydrase polypeptide having increased stability in the presence of ammonia comprises at least the amino acid residue differences relative to SEQ ID NO: 2: X4M, X15R, X30R, X32K, X35A, X56S, X70I, X84Q, X95V, X131L, T139Q, V157A, and X221C. In some embodiments, the amino acid sequence comprises at least a combination of amino acid residue differences relative to SEQ ID NO: 2 present in any one of the polypeptide sequences of SEQ ID NO: 1160-1172. In some embodiments, the amino acid sequence comprises any one of the polypeptide sequences of SEQ ID NO: 1160-1172.

As described in Tables 2A 2B, 2C, 2D, 2E, 2F, 2G, 2H, 2I, and 2J and the Examples, the improved property of increased stability and/or increased activity are determined under suitable conditions. In some embodiments, improved property comprises at least 1.2-fold, at least 1.3-fold, at least 1.5-fold, at least 2-fold, at least 3-fold, at least 4-fold, at least 5-fold, at least 10-fold, or at least 25-fold increased activity of hydrating carbon dioxide or dehydrating bicarbonate under suitable conditions. In some embodiments, the suitable conditions comprise a carbonic anhydrase polypeptide concentration of from about 0.1 g/L to about 10 g/L, about 0.25 g/L to about 7.5 g/L, about 0.5 g/L to about 5 g/L, less than 10 g/L, less than about 5 g/L, or less than about 2.5 g/L. In some embodiments, the suitable conditions comprise a loading of solution $CO_2$ of from about $\alpha=0.005$ to about $\alpha=0.4$, from about $\alpha=0.01$ to about $\alpha=0.3$, $\alpha=0.015$ to about $\alpha=0.25$, $\alpha=0.02$ to about $\alpha=0.2$, less than about $\alpha=0.3$, less than about $\alpha=0.25$, or less than about $\alpha=0.2$.

In some embodiments the improved property is activity measured after exposure of the carbonic anhydrase to thermal or solvent challenge conditions. Accordingly in some embodiments, the increased activity is determined after heating the recombinant carbonic anhydrase polypeptide and the reference polypeptide at a temperature of from about 30° C. to 60° C. for a period of time of about 60 minutes to about 1440 minutes. In such embodiments, the fold-increase in activity corresponds to the same fold-increase in thermostability or solvent stability—depending on the challenge conditions. Various other challenge conditions may be used as disclosed in the Examples and elsewhere herein.

In some embodiments the improved property is stability in the presence of an amine compound and the suitable conditions comprise a solution comprising an amine compound selected from the group consisting of: 2-(2-aminoethylamino)ethanol (AEE), 2-amino-2-hydroxymethyl-1,3-propanediol (AHPD), 2-amino-2-methyl-1-propanol (AMP), diethanolamine (DEA), diisopropanolamine (DIPA), N-hydroxyethylpiperazine (HEP), N-methyldiethanolamine (MDEA), monoethanolamine (MEA), N-methylpiperazine (MP), piperazine, piperidine, 2-(2-tert-butylaminoethoxy)ethanol (TBEE), triethanolamine (TEA), triisopropanolamine (TIA), tris, 2-(2-aminoethoxy)ethanol, 2-(2-tert-butylaminopropoxy)ethanol, 2-(2-tert-amylaminoethoxy)ethanol, 2-(2-isopropylaminopropoxy)ethanol, 2-(2-(1-methyl-1-ethylpropylamino)ethoxy)ethanol, and mixtures thereof. In some embodiments, the amine compound is selected from AMP, MEA, MDEA, TIA, and mixtures thereof. Further, in some embodiments the suitable conditions comprise an amine compound at a concentration of from about 1 M to about 10 M, from about 2 M to about 8 M, from about 2.5 M to about 6.5 M, from about 3 M to about 5 M, at least about 2 M, at least about 3 M, at least about 4.2 M, or at least about 5 M.

Solutions of amine compounds used for carbon dioxide absorption from gas streams typically are used at elevated temperatures. Accordingly, in some embodiments the improved property is stability in the presence of an amine compound and the suitable conditions comprise a solution temperature of from about 40° C. to about 110° C., from about 40° C. to about 90° C., from about 40° C. to about 80°, from about 40° C. to about 70° C., or from about 40° C. to about 60° C.

Solutions containing ammonia that are used for carbon dioxide absorption from gas streams can be used at either or both chilled temperatures (e.g., for absorption) and elevated temperatures (e.g., for desorption of carbon dioxide). Accordingly, in some embodiments, the improved property is stability in ammonia and the suitable conditions comprise a solution temperature of from about 0° C. to about 20° C., from about 0° C. to about 10° C., from about 5° C. to about 15° C., from about 8° C. to about 12° C., less than about 15° C., or less than about 10° C. Further, in some embodiments the suitable conditions comprise an ammonia concentration of about 1 M to about 8 M, from about 2 M to about 7 M, from about 3 M to about 6 M, at least about 1 M, at least about 2 M, at least about 3 M, at least about 4 M, or at least about 5 M, or at least about 5.6 M.

Some solutions for the absorption of carbon dioxide from gas streams include high concentrations of carbonate ion ($CO_3^{2-}$). Typically, the carbonate ion is provided in the form of potassium carbonate ($K_2CO_3$) or sodium carbonate ($Na_2CO_3$). Accordingly, in some embodiments of the recombinant carbonic anhydrase polypeptides, the improved property is increased stability in solution comprising carbonate ion under suitable conditions, wherein the suitable conditions comprise a solution comprising carbonate ion at a concentration of about 0.1 M $CO_3^{2-}$ to about 5 M $CO_3^{2-}$, from about 0.2 M $CO_3^{2-}$ to about 4 M $CO_3^{2-}$, or from about 0.3 M $CO_3^{2-}$ to about 3 M $CO_3^{2-}$.

The present disclosure also contemplates a recombinant carbonic anhydrase polypeptide having at least 1.3-fold, at least 1.5-fold, at least 2-fold, at least 3-fold, or at least 5-fold increased stability relative to the polypeptide of SEQ ID NO: 2, wherein the recombinant polypeptide comprises an amino acid sequence having at least 80%, 85%, 86%, 87%, 88%, 89%, 90%, 91%, 92%, 93%, 94%, 95%, 96%, 97%, 98%, or 99% identity to SEQ ID NO: 2, and further comprises a set of amino acid residue differences as compared to SEQ ID NO:2, wherein the amino acid differences are based on locations or regions in the structure of reference polypeptide (e.g., SEQ ID NO: 2) and/or the associated functional properties. Accordingly, referring to Table 3, a recombinant carbonic anhydrase polypeptide of the present disclosure can include an amino acid substitution at a particular residue at a location in the structure of the reference polypeptide as identified in Table 3. Exemplary substitutions at relevant locations include those identified in Tables 2A 2B, 2C, 2D, 2E, 2F, 2G, 2H, 2I, and 2J.

TABLE 3

| Position | Structural Location |
|---|---|
| X2 | Surface Exposed |
| X3 | Surface Exposed |
| X4 | Surface Exposed |
| X6 | Surface Exposed |
| X7 | Surface Exposed |
| X8 | Surface Exposed |
| X12 | Surface Exposed |
| X13 | Buried |
| X14 | Buried |
| X15 | Surface Exposed |
| X16 | Surface Exposed |
| X17 | Buried |

TABLE 3-continued

| Position | Structural Location |
|---|---|
| X18 | Surface Exposed |
| X19 | Surface Exposed |
| X20 | Buried |
| X21 | Buried |
| X22 | Surface Exposed |
| X23 | Surface Exposed |
| X24 | Buried |
| X25 | Surface Exposed |
| X26 | Surface Exposed |
| X27 | Surface Exposed |
| X28 | Surface Exposed |
| X30 | Surface Exposed |
| X36 | Surface Exposed |
| X37 | Surface Exposed |
| X38 | Surface Exposed |
| X39 | Buried |
| X41 | Surface Exposed |
| X42 | Buried |
| X43 | Surface Exposed |
| X44 | Surface Exposed |
| X46 | Active Site - Outer Sphere |
| X47 | Surface Exposed |
| X48 | Buried |
| X50 | Buried |
| X51 | Buried |
| X52 | Buried |
| X53 | Buried |
| X54 | Active Site - Outer Sphere - Buried |
| X55 | Metal Coordinating - Buried |
| X56 | Active Site - Outer Sphere - Buried |
| X57 | Metal Coordinating - Buried |
| X58 | Active Site - Outer Sphere - Buried |
| X59 | Active Site - Outer Sphere - Buried |
| X60 | Active Site - Outer Sphere - Buried |
| X61 | Buried |
| X62 | Buried |
| X63 | Buried |
| X64 | Buried |
| X65 | Buried |
| X66 | Buried |
| X67 | Buried |
| X68 | Buried |
| X69 | Buried |
| X70 | Buried |
| X71 | Buried |
| X72 | Buried |
| X73 | Buried |
| X74 | Active Site - Outer Sphere - Buried |
| X75 | Buried |
| X76 | Active Site - Outer Sphere - Buried |
| X77 | Active Site - Outer Sphere - Buried |
| X78 | Active Site - Outer Sphere - Buried |
| X79 | Active Site - Inner Sphere - Buried |
| X80 | Active Site - Inner Sphere - Buried |
| X81 | Active Site - Outer Sphere - Buried |
| X82 | Active Site - Outer Sphere - Buried |
| X83 | Buried |
| X84 | Buried - Dimer-dimer interface region |
| X85 | Buried - Dimer-dimer interface region |
| X86 | Buried |
| X87 | Buried |
| X88 | Buried |
| X89 | Buried |
| X90 | Active Site - Outer Sphere - Buried |
| X91 | Buried |
| X92 | Buried |
| X93 | Active Site - Outer Sphere |
| X94 | Active Site - Outer Sphere - Buried |
| X95 | Buried |
| X97 | Active Site - Outer Sphere - Surface Exposed |
| X98 | Active Site - Outer Sphere - Surface Exposed |
| X100 | Buried |
| X101 | Buried |
| X102 | Buried |
| X103 | Buried |
| X104 | Buried |
| X105 | Buried |
| X106 | Active Site - Outer Sphere - Buried |
| X107 | Active Site - Outer Sphere - Buried |
| X108 | Metal Coordinating - Buried |
| X109 | Active Site - Outer Sphere |
| X110 | Active Site - Outer Sphere - Surface Exposed |
| X111 | Metal Coordinating - Buried |
| X112 | Active Site - Inner Sphere |
| X113 | Active Site - Inner Sphere - Buried |
| X114 | Active Site - Outer Sphere - Buried |
| X115 | Active Site - Outer Sphere - Surface Exposed |
| X116 | Active Site - Outer Sphere |
| X117 | Active Site - Outer Sphere - Buried |
| X119 | Surface Exposed |
| X120 | Buried - Dimer-dimer interface region |
| X121 | Buried - Dimer-dimer interface region |
| X122 | Surface Exposed - Dimer-dimer interface region |
| X123 | Surface Exposed - Dimer-dimer interface region |
| X124 | Buried - Dimer-dimer interface region |
| X125 | Buried - Dimer-dimer interface region |
| X126 | Surface Exposed - Dimer-dimer interface region |
| X127 | Dimer-dimer interface region |
| X128 | Dimer-dimer interface region |
| X129 | Surface Exposed - Dimer-dimer interface region |
| X130 | Buried - Dimer-dimer interface region |
| X131 | Buried - Dimer-dimer interface region |
| X132 | Buried - Dimer-dimer interface region |
| X133 | Buried - Dimer-dimer interface region |
| X134 | Dimer-dimer interface region |
| X135 | Active Site - Outer Sphere - Buried - Dimer-dimer interface region |
| X136 | Buried - Dimer-dimer interface region |
| X137 | Buried - Dimer-dimer interface region |
| X138 | Dimer-dimer interface region |
| X139 | Buried - Dimer-dimer interface region |
| X140 | Dimer-dimer interface region |
| X141 | Dimer-dimer interface region |
| X142 | Buried - Dimer-dimer interface region |
| X143 | Buried - Dimer-dimer interface region |
| X144 | Buried - Dimer-dimer interface region |
| X145 | Dimer-dimer interface region |
| X146 | Buried - Dimer-dimer interface region |
| X147 | Surface Exposed - Dimer-dimer interface region |
| X148 | Surface Exposed - Dimer-dimer interface region |
| X149 | Surface Exposed - Dimer-dimer interface region |
| X150 | Surface Exposed |
| X151 | Buried |
| X152 | Surface Exposed |
| X153 | Surface Exposed |
| X154 | Surface Exposed |
| X155 | Surface Exposed |
| X156 | Surface Exposed |
| X157 | Buried |
| X158 | Active Site - Outer Sphere - Buried |
| X160 | Buried |
| X161 | Active Site - Outer Sphere - Buried |
| X162 | Buried |
| X163 | Surface Exposed |
| X164 | Dimer-dimer interface region |
| X165 | Buried - Dimer-dimer interface region |
| X166 | Buried - Dimer-dimer interface region |
| X167 | Dimer-dimer interface region |
| X168 | Dimer-dimer interface region |
| X169 | Buried - Dimer-dimer interface region |
| X170 | Dimer-dimer interface region |
| X171 | Dimer-dimer interface region |
| X172 | Buried - Dimer-dimer interface region |
| X173 | Buried - Dimer-dimer interface region |
| X174 | Dimer-dimer interface region |
| X175 | Dimer-dimer interface region |
| X176 | Buried - Dimer-dimer interface region |
| X177 | Surface Exposed - Dimer-dimer interface region |
| X178 | Surface Exposed |
| X181 | Surface Exposed |
| X182 | Surface Exposed |
| X184 | Surface Exposed |
| X185 | Buried |
| X186 | Buried |
| X187 | Buried |
| X188 | Buried |

TABLE 3-continued

| Position | Structural Location |
| --- | --- |
| X189 | Buried |
| X190 | Buried |
| X191 | Buried |
| X192 | Active Site - Outer Sphere - Buried |
| X193 | Surface Exposed |
| X194 | Active Site - Outer Sphere - Buried |
| X195 | Surface Exposed |
| X196 | Surface Exposed |
| X197 | Buried |
| X198 | Surface Exposed |
| X199 | Buried |
| X200 | Surface Exposed |
| X201 | Surface Exposed |
| X202 | Surface Exposed |
| X203 | Buried |
| X204 | Surface Exposed |
| X205 | Surface Exposed |
| X207 | Surface Exposed |
| X208 | Surface Exposed |
| X209 | Surface Exposed |

"inner sphere" - residue has an atom within 4.5 angstroms of the bound metal at active site.
"outer sphere" - residue within 4.5 angstroms of an inner sphere residue.

In some embodiments, any of the recombinant carbonic anhydrase polypeptides having at least 1.3-fold, at least 1.5-fold, at least 2-fold, at least 3-fold, or at least 5-fold increased stability relative to the polypeptide of SEQ ID NO: 2 and an amino acid sequence having at least 80%, 85%, 86%, 87%, 88%, 89%, 90%, 91%, 92%, 93%, 94%, 95%, 96%, 97%, 98%, or 99% identity to SEQ ID NO: 2, can further comprise at least one amino acid residue difference selected from each of at least two of the following seven sets (i.e., (a) through (g)) of amino acid residue differences: (a) X2R; X2T; X4F; (b) X121H; X121K; X121L; X121Q; X121T; X121V; X121W; X144A; X144L; X178G; (c) X139H; X139K; X139M; (d) X30A; X30L; X30Q; X30R; X40L; X40W; X68A; X96A; X96C; X96E; X96K; X119K; X119L; X119M; X119T; X120R; (e) X35R; X124G; X147E; X147F; X147G; X147T; X159H; X159R; (f) X31P; and (g) X56S; X84N; X84Q; X84S. In some embodiments, the recombinant carbonic anhydrase polypeptide amino acid sequence comprises one amino acid residue difference selected from each of at least two, three, four, five, six, or all seven of the sets of amino acid residue differences.

Structural modeling and homology analysis indicate that the wild-type β-class carbonic anhydrase polypeptide from *D. vulgaris* of SEQ ID NO: 2 can form a dimer-of-dimers protein structure. The dimer-dimer interface regions occur at amino acid positions X84-X85, X120-X149, and X164-X177 of the wild-type polypeptide monomer of SEQ ID NO: 2. In particular, strong dimer-dimer interface region interactions can occur between amino acids at residue positions X121-X126 of one monomer with amino acids at residue positions X144-X149 of the opposite monomer of the dimer It is a surprising discovery of the present disclosure based on the amino acid differences found in the exemplary engineered carbonic anhydrase polypeptides of Tables 2G, 2I, and 2J, that amino acid residue differences providing positively charged lysine (K) or arginine (R) residues in the positions of the dimer-dimer interface region provide increased stability in the presence of amine compounds, such as MDEA. Accordingly, in some embodiments, the present disclosure provides a recombinant carbonic anhydrase polypeptide having increased stability in the presence of amine compound relative to the wild-type β-class carbonic anhydrase of SEQ ID NO: 2, wherein the polypeptide comprises an amino acid sequence having at least 80% identity to SEQ ID NO: 1152 and at least 2, at least 3, at least 4, at least 5, or more lysine (K) and/or arginine (R) residues substituted at positions X84-X85, X120-X149, and/or X164-X177 relative to SEQ ID NO: 2. In some embodiments, the recombinant carbonic anhydrase polypeptide comprises at least 2, at least 3, at least 4, or at least 5 lysine (K) residues and/or arginine (R) residues substituted at positions X121-X126 and/or at positions X144-X149 relative to SEQ ID NO: 2. In some embodiments, the at least 2, at least 3, at least 4, or at least 5 lysine (K) residue and/or arginine (R) residue substitutions are selected from: X84K, X84R, X120R, X121K, X123K, X124R, X129K, X129R, X139K, X143R, X144R, and X148K. In some embodiments, the at least 2, at least 3, at least 4, or at least 5 lysine (K) residues and/or arginine (R) residues substitutions are selected from: X84R, X123K, X124R, X129K, X129R, X143R, X144R, and X148K. In some embodiments, the recombinant carbonic anhydrase polypeptide with increased stability comprising an amino acid sequence having at least 80% identity to SEQ ID NO: 1152 and lysine (K) residues or arginine (R) residues substituted at positions X121-X126 and/or at positions X144-X149 relative to SEQ ID NO: 2, further is characterized in having at least 30% residual activity following exposure to a solution comprising 4.2 M MDEA at 50° C. for a period of time of at least about 1 day, 4 days, 7 days, 12 days, 14 days, or longer.

An analysis of the amino acid sequences of other naturally occurring β-class homologs which have more than 40% identity to SEQ ID NO: 2, shows that approximately 85% have a valine at position X60. The β-class carbonic anhydrase from *D. vulgaris* of SEQ ID NO: 2 has an alanine at position X60. Structurally, the alanine at position X60 of SEQ ID NO: 2 resides just outside the metal binding site but contacts three of the four zinc coordinating residues C55, D57, and H108. Without being bound by mechanism, the structure-function correlation between the alanine at position X60 so close to the metal binding site and increased beta-class specific activity suggests that the volumetric change resulting from alanine rather than valine at position X60 results in greater active site flexibility, which in turn results in the greater catalytic efficiency of the β-class carbonic anhydrase from *D. vulgaris* even at lower temperatures (e.g., 5° C. to 15° C.).

In some embodiments, the present disclosure provides a β-class carbonic anhydrase polypeptide capable of hydrating carbon dioxide in a solution comprising an amine compound or ammonia, wherein the polypeptide comprises an amino acid sequence at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identical to any one of beta cabonic anhydrases polypeptides of SEQ ID NO:2, 1174, 1176, 1178, 1180, or 1182, and has an alanine residue at position X60 relative to SEQ ID NO: 2. In some embodiments of the β-class carbonic anhydrase polypeptides the amino acid sequence can further comprise one or more of the following amino acid residue differences relative to SEQ ID NO: 2: X2R; X2T; X4F; X4M; X15R; X16S; X22G; X30A; X30K; X30L; X30Q; X30R; X31P; X32K; X32R; X34H; X35A; X35R; X36T; X37C; X37R; X40L; X40Q; X40W; X42A; X43M; X43V; X47R; X56S; X60C; X60V; X68A; X68G; X68V; X70I; X84K; X84N; X84Q; X84R; X84S; X86A; X93W; X95V; X96A; X96C; X96E; X96K; X97F; X119K; X119L; X119M; X119T; X120R; X121H; X121K; X121L; X121Q; X121T; X121V; X121W; X124F; X124G; X124R; X131L; X131F; X138F; X138L; X138W; X139H; X139K; X139M; X139Q; X142L; X143M; X143R; X144A; X144L; X145C; X145F; X145L; X145W; X147E; X147F; X147G; X147T; X148A; X148C; X148T; X156L; X157A;

X159H; X159R; X159V; X168E; X170F; X178G; X200R; X207E; X207N; X213E; X213Q; X219T; X221C; X222C; X223C; and X223Q.

In addition to the residue positions specified above, any of the recombinant carbonic anhydrase polypeptides disclosed herein can further comprise other residue differences relative to SEQ ID NO:2 at other residue positions. Residue differences at these other residue positions provide for additional variations in the amino acid sequence without adversely affecting the ability of the recombinant carbonic anhydrase polypeptide to carry out the hydration of carbon dioxide to bicarbonate and/or increased stability relative to the polypeptide of SEQ ID NO: 2. In some embodiments, the polypeptides can have additionally 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40 residue differences at other amino acid residue positions as compared to the reference sequence. In some embodiments, the number of differences can be 1, 2, 3, 4, 5, 6, 7, 8, 9, 10, 11, 12, 14, 15, 16, 18, 20, 22, 24, 26, 30, 35, and 40 residue differences at other residue positions. The residue difference at these other positions can include conservative changes or non-conservative changes. In some embodiments, the residue differences can comprise conservative substitutions and non-conservative substitutions as compared to the wild-type carbonic anhydrase of SEQ ID NO: 2.

In some embodiments, the present disclosure provides recombinant carbonic anhydrase polypeptides that comprise deletions of the recombinant carbonic anhydrase polypeptides expressly described herein. Thus, for each and every embodiment comprising an amino acid sequence, there is another embodiment comprising a sequence having one or more amino acid deletions, 2 or more amino acid deletions, 3 or more amino acid deletions, 4 or more amino acid deletions, 5 or more amino acid deletions, 6 or more amino acid deletions, 8 or more amino acid deletions, 10 or more amino acid deletions, 15 or more amino acid deletions, or 20 or more amino acid deletions, up to 10% of the total number of amino acids deleted, up to 20% of the total number of amino acids deleted, as long as the functional activity of the polypeptide with respect to the hydration of carbon dioxide to bicarbonate with increased stability is present. In some embodiments, the deletions can comprise, 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, or 1-40 amino acid residues. In some embodiments, the number of deletions can be 1, 2, 3, 4, 5, 6, 7, 8, 9, 10, 11, 12, 14, 15, 16, 18, 20, 22, 24, 26, 30, 35, or 40 amino acids. In some embodiments, the deletions can comprise deletions of 1, 2, 3, 4, 5, 6, 7, 8, 9, 10, 11, 12, 13, 14, 15, 16, 18, or 20 amino acid residues.

In some embodiments, the polypeptides can comprise fragments of the recombinant carbonic anhydrase polypeptides described herein. In some embodiments, the fragments can have about 80%, 90%, 95%, 98%, and 99% of the full-length polypeptide, e.g., the polypeptide of SEQ ID NO:2, as long as the functional activity of the polypeptide with respect to the hydration of carbon dioxide to bicarbonate with increased stability is present.

In some embodiments, the polypeptides of the disclosure can be in the form of fusion polypeptides in which the recombinant carbonic anhydrase polypeptides are fused to other polypeptides, such as, by way of example and not limitation, antibody tags (e.g., myc epitope), purifications sequences (e.g., His tags for binding to metals), and cell localization signals (e.g., secretion signals). Thus, the recombinant carbonic anhydrase polypeptides described herein can be used with or without fusions to other polypeptides.

The polypeptides described herein are not restricted to the naturally-occurring genetically encoded L-amino acids but also include the D-enantiomers of the genetically-encoded amino acids. In addition to the genetically encoded amino acids, the polypeptides described herein may be comprised, either in whole or in part, of naturally-occurring and/or synthetic non-encoded amino acids that are known in the art (see, e.g., the various amino acids provided in Fasman, 1989, CRC Practical Handbook of Biochemistry and Molecular Biology, CRC Press, Boca Raton, Fla., at pp. 3-70 and the references cited therein, all of which are incorporated by reference). For example, conformationally constrained non-encoded amino acids of which the polypeptides described herein may be composed include: N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid. Additionally, those of skill in the art will recognize that amino acids bearing side chain protecting groups may also comprise the polypeptides described herein—e.g., Arg(tos), Cys(methylbenzyl), Cys (nitropyridinesulfenyl), Glu(δ-benzylester), Gln(xanthyl), Asn(N-δ-xanthyl), His(bom), His(benzyl), His(tos), Lys(fmoc), Lys(tos), Ser(O-benzyl), Thr (O-benzyl) and Tyr(O-benzyl).

As described above the various modifications introduced into the naturally occurring polypeptide to generate an engineered carbonic anhydrase enzyme can be targeted to a specific property of the enzyme.

Any of the above-described carbonic anhydrase polypeptides useful for chemical modification can be prepared by the ordinary artisan using the polynucleotide sequences disclosed herein (e.g., in Tables and Sequence Listing) and standard molecular biology and biochemical techniques for further mutagenesis, preparation, isolation, purification, and manufacture of the enzymes. For example, the disclosed polynucleotides may be operatively linked to one or more heterologous regulatory sequences that control gene expression to create a recombinant polynucleotide capable of expressing the polypeptide. Expression constructs containing a heterologous polynucleotide encoding the engineered carbonic anhydrase can be introduced into appropriate host cells to express the corresponding carbonic anhydrase polypeptide. Manipulation of the isolated polynucleotide prior to its insertion into an expression vector may be desirable or necessary depending on the expression vector. The techniques for modifying polynucleotides and nucleic acid sequences utilizing recombinant DNA methods are well known in the art. Guidance is provided in Sambrook et al., 2001, Molecular Cloning: A Laboratory Manual, 3rd Ed., Cold Spring Harbor Laboratory Press; and Current Protocols in Molecular Biology, Ausubel. F. ed., Greene Pub. Associates, 1998, updates to 2006. Example 1 of the present disclosure provides exemplary techniques.

Additionally, methods for producing the above-described carbonic anhydrase polypeptides in host cells are well-known to the skilled artisan. For example, polynucleotides for expression of the carbonic anhydrase may be introduced into host cells by various methods known in the art. Techniques include among others, electroporation, biolistic particle bombardment, liposome mediated transfection, calcium chloride transfection, and protoplast fusion. In some embodiments, more than one copy of a polynucleotide sequence is inserted into a host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

An exemplary host cells for use in producing the recombinant carbonic anhydrase polypeptides of the present disclosure is *Escherichia coli* W3110 and *Escherichia coli* BL21. An expression vector encoding an improved carbonic anhydrase of the present disclosure can be created by operatively linking a polynucleotide into the plasmid pCK110900 (see, U.S. application publication 20040137585) operatively linked to the lac promoter under control of the lad repressor. The expression vector also contained the P15a origin of replication and the chloramphenicol resistance gene. Cells containing the subject polynucleotide in *Escherichia coli* W3110 can be isolated by subjecting the cells to chloramphenicol selection. Example 1 of the present disclosure provides exemplary techniques.

The carbonic anhydrase enzymes expressed in a host cell can be recovered from the cells and or the culture medium using any one or more of the well known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available under the trade name CelLytic B™ from Sigma-Aldrich of St. Louis Mo. Additionally, due to their enhanced thermostability, the engineered carbonic anhydrase polypeptides of the present disclosure can be recovered, isolated and/or purified from other cellular protein components by heat purification. Typically, after heating the desired engineered carbonic anhydrase remains in solution due its increased thermostability, but all or nearly all of the other protein components in the solution denature and can be separated easily from the solution by e.g., centrifugation. Methods for recovery of thermostable proteins by heat purification are well-known in the art.

8.5. Methods of Using Chemically Modified Carbonic Anhydrase Polypeptides

The chemically modified carbonic anhydrase enzymes described herein can catalyze both the forward and reverse reactions depicted in Scheme 1. In certain embodiments, the chemically modified carbonic anhydrase of the present disclosure can be used to hydrate carbon dioxide in the form of bicarbonate and a proton, which in turn, will be converted to carbonate and/or a mixture of bicarbonate and carbonate at an elevated pH. In other embodiments, a chemically modified carbonic anhydrase of the disclosure can be used to dehydrate carbon dioxide by reaction at a relatively acidic pH, thereby catalyzing the release of hydrated $CO_2$ from solution.

Accordingly, in some embodiments the present disclosure provides methods for removing carbon dioxide from a gas stream (e.g., capturing or extracting $CO_2$ gas) comprising the step of contacting the gas stream with a homogenous liquid solution under suitable conditions, wherein the solution comprises: (i) a chemically modified carbonic anhydrase polypeptide of the disclosure (e.g., chemically modified polypeptide having improved property such as increased activity, thermostability and/or solvent stability); and (ii) a $CO_2$ absorption mediating compound (e.g., ammonia, or an amine compound such as MDEA); whereby carbon dioxide from the gas stream is absorbed into the solution (e.g., $CO_2$ gas diffuses into solution and is hydrated to bicarbonate).

In some embodiments, the methods of use can be carried out wherein the chemically modified carbonic anhydrase polypeptide used is capable of catalyzing the hydration of carbon dioxide to bicarbonate or the reverse dehydration of bicarbonate to carbon dioxide with increased activity relative to the same carbonic anhydrases that are not chemically modified (and other known naturally occurring carbonic anhydrases) after exposure to high concentrations of $CO_2$ absorption mediating compound and/or thermal (e.g., T>40° C.). For example, in some embodiments, a chemically modified carbonic anhydrase of the present disclosure is used having carbonic anhydrase activity in 4.2 M MDEA at 50° C. that is increased (e.g., at least 1.5-fold, at least 2-fold, at least 4-fold, or even at least 5-fold increased) relative to the activity of the same carbonic anhydrase polypeptide that is not chemically modified (i.e., unmodified). Similarly, in some embodiments of the methods, the chemically modified carbonic anhydrase used is characterized by stability in 4.2 M MDEA at 75° C. that is increased (e.g., at least 1.5-fold, at least 2-fold, at least 4-fold, or even at least 5-fold increased) relative to the carbonic anhydrase polypeptide when it is not chemically modified.

The chemically modified carbonic anhydrase polypeptides having these (and other) improved properties useful in the methods include those disclosed elsewhere herein, include those provided in the Examples. In some embodiments, the method of use can be carried out wherein the carbonic anhydrase polypeptide chemically modified by treatment with a cross-linking agent is a naturally occurring carbonic anhydrase selected from an α-class, γ-class, β-class, or ζ-class carbonic anhydrase, or a recombinant (or engineered) carbonic anhydrase derived from a naturally occurring α-class, γ-class, β-class, or ζ-class carbonic anhydrase. In some embodiments, the polypeptide is an α-class carbonic anhydrase that comprises an amino acid sequence selected from the group consisting of SEQ ID NO: 1298, 1300, 1302, 1304, 1306, and 1308, or a recombinant carbonic anhydrase polypeptide derived from any one of these α-class carbonic anhydrase sequences.

In some embodiments of the methods, the carbonic anhydrase polypeptide is a recombinant β-class carbonic anhydrase polypeptide derived from the wild-type *Desulfovibrio vulgaris* carbonic anhydrase comprising the amino acid sequence of SEQ ID NO: 2, or derived from a sequence homolog of SEQ ID NO: 2 selected from the group consisting of SEQ ID NO: 1288, 1290, 1292, 1294, and 1296. Engineered polypeptides useful in embodiments of the method are provided in Tables 2A, 2B, 2C, 2D, 2E, 2F, 2G, 2H, 2I, and 2J. In some embodiments, the carbonic anhydrase polypeptide amino acid sequence comprises an even-numbered amino acid sequence selected from any one of SEQ ID NO: 4-1286. In such embodiments comprising a polypeptide based on the β-class polypeptide of SEQ ID NO: 2, the carbonic anhydrase polypeptide amino acid sequence has surface lysine residues at the following positions (relative to SEQ ID NO: 2): X18, X37, X147, X156, X184, or X198. Accordingly, in some embodiments of the methods the polypeptide is a recombinant β-class carbonic anhydrase having an amino acid sequence derived from SEQ ID NO: 2, and the treatment with a cross-linking agent results in a carbonic anhydrase polypeptide having a chemically modified lysine residue at one or more of the following positions relative to SEQ ID NO: 2: X18, X37, X147, X156, X184, or X198. In some embodiments of the methods of use, the carbonic anhydrase polypeptide amino acid sequence comprises at least the following amino acid residue difference relative to SEQ ID NO: 2: X56S. In some embodiments, the carbonic anhydrase polypeptide amino acid sequence comprises at least the following amino acid residue difference relative to SEQ ID NO: 2: X30R, X40L, X56S, X84Q, X120R, and X139M. In some embodiments of the methods of use, the carbonic anhydrase polypeptide amino acid sequence an amino acid sequence selected from any one of SEQ ID NO: 26, 190, 206, 238, 252, 270, 274, 284, 306, 318, 328, 332, 340, 354, 596, 606, 656, 678, 1080, 1110, 1148, 1152, 1156, and 1158.

In some embodiments of the method of use, the polypeptide is characterized by an amino acid sequence having at least 80% identity to SEQ ID NO:2 and at least one residue chemically modified by treatment with a cross-linking agent selected from the group consisting of: glutaraldehyde, dimethyl suberimidate, dimethyl pimelimidate, suberic acid bis (N-hydroxysuccinimide), and mixtures thereof. In some embodiments, the at least one residue that is chemically modified by treatment with a cross-linking agent is a surface lysine residue at one or more of the following positions relative to SEQ ID NO: 2: X18, X37, X147, X156, X184, or X198.

In some embodiments, the methods of removing carbon dioxide from a gas stream using a chemically modified carbonic anhydrase can be carried out wherein the carbonic anhydrase polypeptide that is chemically modified comprises a naturally occurring β-class carbonic anhydrase polypeptide of any one of SEQ ID NO: 2, 1288, 1290, 1292, 1294, and 1296. In some embodiments, the methods can be carried out using the carbonic anhydrase polypeptide of SEQ ID NO: 2. In some embodiments, the methods can be carried out using a β-class carbonic anhydrase polypeptide, wherein the polypeptide comprises an amino acid sequence at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identical SEQ ID NO:2 and has an alanine residue at position X60 relative to SEQ ID NO: 2.

In some embodiments, the methods of removing carbon dioxide from a gas stream using a chemically modified carbonic anhydrase can be carried out wherein the carbonic anhydrase polypeptide that is chemically modified comprises an amino acid sequence that is at least about 85%, 86%, 87%, 88%, 89%, 90%, 91%, 92%, 93%, 94%, 95%, 96%, 97%, 98%, or 99% identical to the amino acid sequence of SEQ ID NO:2, and comprises one or more amino acid differences relative to SEQ ID NO: 2 selected from the group consisting of: X2R; X2T; X4F; X4M; X15R; X16S; X22G; X30A; X30K; X30L; X30Q; X30R; X31P; X32K; X32R; X34H; X35A; X35R; X37R; X40L; X40Q; X40W; X42A; X43M; X43V; X47R; X56S; X60C; X60V; X68A; X68G; X70I; X84K; X84N; X84Q; X84R; X84S; X86A; X95V; X96A; X96C; X96E; X96K; X97F; X119K; X119L; X119M; X119T; X120R; X121H; X121K; X121L; X121Q; X121T; X121V; X121W; X124G; X124R; X131L; X138F; X138L; X138W; X139H; X139K; X139M; X139Q; X142L; X143M; X144A; X144L; X145C; X145F; X145W; X147E; X147F; X147G; X147T; X148A; X148T; X157A; X159H; X159R; X159V; X168E; X170F; X178G; X200R; X207E; X207N; X213E; X213Q; X219T; X221C; X222C; X223C; and X223Q. The foregoing carbonic anhydrase polypeptides may further comprise additional modifications, including substitutions, deletions, insertions, or combinations thereof. The substitutions can be non-conservative substitutions, conservative substitutions, or a combination of non-conservative and conservative substitutions. In some embodiments, these carbonic anhydrase polypeptides can have optionally from about 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-25, 1-30, 1-35 or about 1-40 mutations at other amino acid residues. In some embodiments, the number of modifications can be 1, 2, 3, 4, 5, 6, 7, 8, 9, 10, 11, 12, 14, 15, 16, 18, 20, 22, 24, 26, 30, 35 or about 40 other amino acid residues.

In certain embodiments, the methods can be carried out using a chemically modified carbonic anhydrase polypeptide of the present disclosure, wherein the polypeptide comprises an amino acid sequence selected from the amino acid sequences of SEQ ID NO: 4-1286 (which correspond to the even-numbered sequence identifier numbers from 4 to 1286, inclusive).

In some embodiments of the methods of use, the cross-linking agent is selected from the group consisting of a dialdehyde, a bis-imidate ester, a bis(N-hydroxysuccinimide)ester, a diacid chloride, and mixtures thereof. In some embodiments, the specific cross-linking agent is selected from the group consisting of malondialdehyde, glutaraldehyde, dimethyl suberimidate, dimethyl pimelimidate, suberic acid bis(N-hydroxysuccinimide), and mixtures thereof. In some embodiments, the cross-linking agent is a dialdehyde having optionally one or more carbon atoms between the two aldehyde groups, for example wherein the dialdehyde is selected from the group consisting of glyoxal, succindialdehyde, malondialdehyde, glutaraldehyde, and mixtures thereof. In a particular embodiment, the cross-linking agent is glutaraldehyde. In some embodiments, the cross-linking agent is an imidate ester, and in particular embodiments, a bis-imidate ester having optionally one or more carbon atoms between the two imidate ester groups. Useful imidate esters include bis-imidate esters having at least 1 carbon atoms between the two imidate ester groups, including but not limited to: imidate esters (such as methyl or ethyl) of malonimidate, succinimidate, glutarimidate, adipimidate, pimelimidate, and suberimidate.

In some embodiments of the methods of use, the cross-linking agent is a bis(N-hydroxysuccinimide)ester of a di-carboxylic acid that forms an irreversible chemical modification of the polypeptide. Useful bis(N-hydroxysuccinimide) esters include those prepared from an di-carboxylic acid selected from the group consisting of malonate, succinate, glutarate, adipate, pimelate, suberate, and mixtures thereof. Accordingly, in particular embodiments of the soluble composition, the cross-linking agent is a bis(N-hydroxysuccinimide)ester of a di-carboxylic acid selected from the group consisting of malonate, succinate, glutarate, adipate, pimelate, suberate, and mixtures thereof.

In other embodiments, the methods of use of the present disclosure can comprise further steps of isolating and/or separately treating the solution comprising the absorbed carbon dioxide. In some embodiments, the carbon dioxide gas in the solution is desorbed (i.e., stripped) by contacting the isolated solution with protons (i.e., acidify) and a chemically modified carbonic anhydrase polypeptide, which may be the same or different than the polypeptide used in the absorption step, thereby converting the hydrated carbon dioxide to carbon dioxide gas and water. In some embodiments, the desorption of carbon dioxide from this separate solution can be carried out at significantly higher temperatures, and/or under lower pressure (e.g., vacuum) conditions that can require a carbonic anhydrase polypeptide (modified or unmodified) having different stability characteristics. Thus, it is contemplated that the solution can be removed from contact with the gas stream (e.g., isolated after some desired level of hydrated carbon dioxide is reached) and further treated with a chemically modified or unmodified carbonic anhydrase to convert the bicarbonate in solution into carbon dioxide gas, which is then released from the solution and sequestered, e.g., into a pressurized chamber.

In some embodiments, the methods for removing carbon dioxide from a gas stream of the present disclosure can comprise a further desorption step comprising exposing the solution comprising the chemically modified carbonic anhydrase polypeptide and absorbed carbon dioxide to suitable conditions for desorbing the carbon dioxide from the solution. In some embodiments, the suitable conditions for desorbing the carbon dioxide from the solution comprise heating the solution to an elevated temperature. In some embodiments, the suitable conditions for desorbing the carbon dioxide from the solution comprise exposing the solution to low pressure or a vacuum. (See e.g., Publ. U.S. Appl. No. 2007/0256559A1.) In some embodiments of the methods using the chemically modified carbonic anhydrase polypeptides of the present disclosure (which exhibit increased stability at elevated temperatures), the elevated temperatures for desorption can comprise a temperature of from about 40° C. to about 120° C., from about 50° C. to about 100° C., from about 50° C. to about 90° C., or at least about 40° C., at least about 50° C., at least about 60° C., at least about 70° C., at least about 80° C., or at least about 90° C.

In other embodiments, the further step of isolating the solution comprising the hydrated carbon dioxide is carried out and no further chemically modified carbonic anhydrase polypeptide is added to the solution. Instead the solution which is enriched in bicarbonate (i.e., hydrated carbon dioxide) can be used in processes that react with the bicarbonate to effectively sequester the carbon dioxide in another chemical form.

In some embodiments, the chemically modified carbonic anhydrases and associated methods for removing (e.g., extracting and sequestering) carbon dioxide from a gas stream disclosed herein can be used in existing systems that use a solution for absorbing carbon dioxide from e.g., flue gas. Equipment, processes, and methods for carbon dioxide capture and sequestration using solutions into which carbon dioxide is absorbed (i.e., captured by diffusing from gas stream into the liquid solution) and/or from which carbon dioxide is desorbed (i.e., extracted by diffusing from liquid solution into gas phase) are described in e.g., U.S. Pat. Nos. 6,143,556, 6,524,843 B2, 7,176,017 B2, 7,596,952 B2, 7,641,717 B2, 7,645,430 B2, 7,579,185 B2, 7,740,689 B2, 7,132,090 B2; U.S. Pat. Publ. Nos. 2007/0004023A1, 2007/0256559A1, 2009/0155889A1, 2010/0086983A1; PCT Publ. Nos. WO98/55210A1, WO2004/056455A1, WO2004/028667A1, WO2006/089423A1, WO2008/072979A1, WO2009/000025A1, WO2010/020017A1, WO2010/014773A1, WO2010/045689A1, each of which is hereby incorporated by reference herein.

Methods for linking (covalently or non-covalently) enzymes to solid-phase particles (e.g., porous or non-porous beads, or solid supports) such that they retain activity for use in bioreactors are known in the art. Methods for treating a gas stream using immobilized enzymes are described in e.g., U.S. Pat. No. 6,143,556, U.S. patent publication no. 2007/0004023A1, and PCT publications WO98/55210A1, WO2004/056455A1, WO2004/028667A1, WO2011/014955A1, WO2011/014956A1, and WO2011/014957A1, each of which is hereby incorporated by reference herein. Accordingly, in alternative embodiments, the methods for removing carbon dioxide from a gas stream can be carried out wherein a chemically modified carbonic anhydrase polypeptide of the present disclosure is immobilized on a surface, for example linked to the surface of a solid-phase particle (e.g., beads) in the solution. Such methods result in a biphasic (or heterogeneous) solution comprising the immobilized chemically modified carbonic anhydrase polypeptide and the solution comprising $CO_2$ and a $CO_2$ absorption mediating compound. In such embodiments, the methods using immobilized chemically modified carbonic anhydrase polypeptides can be carried out wherein the method further comprises a step of isolating or separating the immobilized chemically modified carbonic anhydrase polypeptide from the solution. After separating the immobilized chemically modified carbonic anhydrase from the solution, the solution can be treated to conditions that may inactivate the enzyme, e.g., desorption of $CO_2$ at high temperatures. Further, the separately retained immobilized enzyme can be added to another solution and reused.

In various embodiments, the methods of removing carbon dioxide from a gas stream using a chemically modified carbonic anhydrase polypeptide disclosed herein may be carried out under a range of suitable conditions. Suitable conditions can be determined by routine experimentation that includes, but is not limited to, contacting the solution containing the chemically modified carbonic anhydrase polypeptide with $CO_2$ at an experimental condition (e.g., amine concentration, temperature, $CO_2$ loading) and then detecting the relevant activity (e.g., rate of $CO_2$ absorption), for example, using the methods described in the Examples provided herein.

The ordinary artisan also will recognize that certain suitable conditions can be selected that favor the absorption of carbon dioxide into a solution (e.g., via hydration of carbon dioxide to bicarbonate) and/or the desorption of carbon dioxide from a solution (e.g., via dehydration of bicarbonate to carbon dioxide and water). The chemically modified carbonic anhydrase polypeptides disclosed herein are biocatalysts having an improved property (e.g., increased activity or thermal stability) that allows them to accelerate the absorption of carbon dioxide gas into a solution and/or accelerate subsequent desorption from the solution under a range of conditions.

In some embodiments, the method can be carried out wherein the chemically modified carbonic anhydrase comprises the improved property at least 1.2-fold, at least 1.3-fold, at least 1.5-fold, at least 2-fold, at least 3-fold, at least 4-fold, at least 5-fold, at least 10-fold, or at least 25-fold increased activity of hydrating carbon dioxide or dehydrating bicarbonate under suitable conditions. Accordingly, in some embodiments, the suitable conditions used in the method can comprise a concentration of the chemically modified carbonic anhydrase polypeptide of from about 0.1 g/L to about 10 g/L, about 0.25 g/L to about 7.5 g/L, about 0.5 g/L to about 5 g/L, less than 10 g/L, less than about 5 g/L, or less than about 2.5 g/L.

The ability of the chemically modified carbonic anhydrase polypeptide to accelerate $CO_2$ absorption into or desorption from a solution can be affected by the mole ratio of $CO_2$ to other compounds already present in the solution, which is also referred to as the $CO_2$ loading of the solution and can be denoted by the mole ratio of $CO_2$ to the moles of the relevant $CO_2$ absorption mediating compound in the solution (e.g., amine compound, ammonia), which is denoted by the term "α." The carbonic anhydrase polypeptides of the present disclosure can be used under a range of loading conditions which can be varied depending on the particular $CO_2$ absorption mediating compound used in the solution. Accordingly, the methods of the disclosure can be carried wherein the suitable conditions comprise a loading of solution $CO_2$ of from about $\alpha=0$ to about $\alpha=0.7$, from about $\alpha=0.01$ to about $\alpha=0.6$, from about $\alpha=0.02$ to about $\alpha=0.5$, from about $\alpha=0.05$ to about $\alpha=0.4$, from about $\alpha=0.1$ to about $\alpha=0.4$, from about $\alpha=0.2$ to about $\alpha=0.3$, less than about $\alpha=0.7$, less than about $\alpha=0.5$, or less than about $\alpha=0.3$.

In some embodiments where the method is carried out in the presence of an amine compound (e.g., 4 M MDEA) the suitable conditions can comprise and a loading of solution $CO_2$ of from about $\alpha=0$ to about $\alpha=0.6$, from about $\alpha=0.01$ to about $\alpha=0.5$, from about $\alpha=0.02$ to about $\alpha=0.4$, from about $\alpha=0.05$ to about $\alpha=0.3$, from about $\alpha=0.1$ to about $\alpha=0.4$, from about $\alpha=0.2$ to about $\alpha=0.3$, less than about $\alpha=0.4$, less than about $\alpha=0.3$, or less than about $\alpha=0.2$.

In some embodiments where the method is carried out in the presence of ammonia (e.g., 10 wt % or 5.6 M $NH_3$) the suitable conditions can comprise a loading of solution $CO_2$ of from about $\alpha=0$ to about $\alpha=0.7$, from about $\alpha=0.1$ to about $\alpha=0.7$, from about $\alpha=0.1$ to about $\alpha=0.5$, from about $\alpha=0.1$ to about $\alpha=0.3$, from about $\alpha=0.4$ to about $\alpha=0.7$, from about $\alpha=0.5$ to about $\alpha=0.7$, less than about $\alpha=0.7$, less than about $\alpha=0.5$, or less than about $\alpha=0.3$.

Additionally, the $CO_2$ loading of the solution can change from "lean" to "rich" during the process as the $CO_2$ is absorbed, and then desorbed. Typically, the initial condition of the solution used in the method is "lean loading" (e.g., $\alpha=0$, or $\alpha=0.01$ to 0.02), and as the absorption proceeds the solution condition becomes "rich loading" (e.g., $\alpha=0.2$ to 0.5, or higher). As illustrated by the Examples herein, the acceleration of $CO_2$ absorption due to enzyme tends to be lower under "lean loading" conditions than under "rich loading" conditions. Further the loading conditions used for the method carried out in the presence of amine compounds tends to be lower than the loading used for the method carried out in the presence of ammonia. Accordingly, in some embodiments, the suitable conditions in the presence of an amine compound comprise a lean loading of solution $CO_2$ from about $\alpha=0$ to about $\alpha=0.02$ and a rich loading of solution $CO_2$ of from about $\alpha=0.2$ to about $\alpha=0.5$. However, in some embodiments, where the suitable conditions include the presence of ammonia, the loading can comprise a lean loading of solution $CO_2$ about $\alpha=0.1$ to about $\alpha=0.3$ and a rich loading of solution $CO_2$ of from about $\alpha=0.5$ to about $\alpha=0.7$.

Typically the gas streams from which $CO_2$ removal is desirable are at elevated temperatures, and upon contacting a solution, as in the method disclosed herein, heat is also transferred and the solution temperature also is elevated. This is particularly true in treating flue gas streams from coal-fired power plants. Accordingly, in some embodiments, the suitable conditions for carrying out the method comprise an elevated solution temperature. The presence of elevated temperature further underscores the importance of using thermostable carbonic anhydrase polypeptides such as those disclosed herein. Thus, in some embodiments the method is carried out wherein the suitable conditions comprise a solution temperature of from about 40° C. to about 110° C., from about 40° C. to about 90° C., from about 40° C. to about 80°, from about 40° C. to about 70° C., or from about 40° C. to about 60° C.

The method of removing carbon dioxide disclosed herein involves contacting the gas stream with a solution comprising a chemically modified carbonic anhydrase polypeptide. The present disclosure has illustrated the use of the method in solutions comprising a high concentration of an amine compound, ammonia, and carbonate ion. A range of other solutions comprising other compounds known to facilitate the absorption of $CO_2$ from a gas stream, and it is contemplated that the present methods could be used with such solutions.

For capturing $CO_2$ from flue gas streams, solutions comprising a variety of different amine compounds are known. Such solutions comprising amine compounds that facilitate $CO_2$ absorption from a gas stream into a solution are described in e.g., PCT Publ. No. WO2006/089423A1, U.S. Pat. No. 7,740,689 B2, or U.S. Pat. Publ. No. 2009/0155889A1, each which is hereby incorporated by reference herein. Accordingly, in some embodiments, the methods of removing carbon dioxide from a gas stream can be carried out wherein the solution comprises an amine compound, preferably an amine compound that exhibits improved thermodynamic and kinetic properties for the absorption of $CO_2$. Thus, in some embodiments of the methods, the suitable conditions comprise a solution comprising an amine compound, and the amine compound can be selected from the group consisting of: 2-(2-aminoethylamino)ethanol (AEE), 2-amino-2-hydroxymethyl-1,3-propanediol (AHPD), 2-amino-2-methyl-1-propanol (AMP), diethanolamine (DEA), diisopropanolamine (DIPA), N-hydroxyethylpiperazine (HEP), N-methyldiethanolamine (MDEA), monoethanolamine (MEA), N-methylpiperazine (MP), piperazine, piperidine, 2-(2-tert-butylaminoethoxy)ethanol (TBEE), triethanolamine (TEA), triisopropanolamine (TIA), tris, 2-(2-aminoethoxy)ethanol, 2-(2-tert-butylaminopropoxy)ethanol, 2-(2-tert-amylaminoethoxy)ethanol, 2-(2-isopropylaminopropoxy)ethanol, 2-(2-(1-methyl-1-ethylpropylamino)ethoxy)ethanol, and mixtures thereof. In some embodiments, the amine compound is selected from the group consisting of: AMP, MEA, MDEA, TIA, and mixtures thereof. In one preferred embodiment the solution comprises the amine compound MDEA. Further, in the embodiments of the methods employing an amine compound in solution, the suitable conditions can comprise an amine compound concentration of from about 1 M to about 10 M, from about 2 M to about 8 M, from about 2.5 M to about 6.5 M, from about 3 M to about 5 M, at least about 2 M, at least about 3 M, at least about 4.2 M, or at least about 5 M.

Elevated temperatures are typically present when the method employs a solution comprising an amine compound are used to remove carbon dioxide from a gas stream. Thus, in some embodiments the method is carried out wherein the suitable conditions comprise a solution comprising an amine compound (e.g., MDEA) and a temperature of from about 40° C. to about 110° C., from about 40° C. to about 90° C., from about 40° C. to about 80°, from about 40° C. to about 70° C., or from about 40° C. to about 60° C.

Another known process for capturing $CO_2$ from a gas stream (e.g., flue gas) uses a solution containing a high concentration of ammonia. Methods and conditions for capturing $CO_2$ using solutions comprising ammonia are described in e.g., WO2009/000025A1, WO2010/020017A1, and WO2010/045689A1, each which is hereby incorporated by reference herein. Due to the high volatility of ammonia vapor processes using ammonia are sometimes run at relatively low temperatures, in what is referred to as a "chilled ammonia" process. Methods and conditions of the chilled ammonia process for $CO_2$ capture from a flue gas stream are described in e.g., U.S. Pat. No. 7,641,717 B2, and U.S. Pat. Publ. No. 2009/0155889A1, each which is hereby incorporated by reference herein. Accordingly, in some embodiments of the methods of removing carbon dioxide disclosed herein, a solution containing ammonia is used to facilitate carbon dioxide absorption from the gas streams. Such ammonia solutions can be used under suitable conditions comprising an ammonia concentration of about 1 M to about 8 M, from about 2 M to about 7 M, from about 3 M to about 6 M, at least about 1 M, at least about 2 M, at least about 3 M, at least about 4 M, or at least about 5 M, or at least about 5.6 M. Further in some embodiments of the methods, the solution comprising ammonia can be used at chilled temperatures (e.g., for absorption) and/or elevated temperatures (e.g., for desorption of carbon dioxide). Accordingly, in some embodiments, the method using a solution comprising ammonia can be carried out wherein the suitable conditions comprise a solution temperature of from about 0° C. to about 20° C., from about 0° C. to about 10° C., from about 5° C. to about 15° C., from about 8° C. to about 12° C., less than about 15° C., or less than about 10° C.

Some processes for $CO_2$ capture from a gas stream use contact with a solution comprising elevated concentration of carbonate ions ($CO_3^{2-}$). Various formulations and processes for $CO_2$ capture from gas streams using solutions comprising carbonate ions are known (see e.g., WO2011/014957A1). Typically, the carbonate ion is provided in the solution in the form of potassium carbonate ($K_2CO_3$) or sodium carbonate ($Na_2CO_3$). In such embodiments, the stability and activity of the chemically modified carbonic anhydrase in the presence of carbonate ions is an important functional characteristic. Accordingly, in some embodiments, the method of removing $CO_2$ from a gas stream can be carried out wherein the suitable conditions comprise a solution comprising carbonate ion at a concentration of about 0.1 M $CO_3^{2-}$ to about 5 M $CO_3^{2-}$, from about 0.2 M $CO_3^{2-}$ to about 4 M $CO_3^{2-}$, or from about 0.3 M $CO_3^{2-}$ to about 3 M $CO_3^{2-}$, at least about 0.2 M $Na_2CO_3$, at least about 0.4 M $Na_2CO_3$, or at least about 1 M $Na_2CO_3$.

In some embodiments, the chemically modified carbonic anhydrase polypeptide of the present disclosure can be used in processes for $CO_2$ capture from a gas stream that comprise contacting the gas stream with a solution comprising the polypeptide and elevated concentration of amino acid compounds. In some embodiments, the amino acid compound is a primary, secondary, or tertiary amino acid, or a derivative or salt thereof (e.g., a sodium salt). Exemplary amino acid compounds useful in the method include, but are not limited to, the twenty most prevalent naturally occurring α-amino acids (i.e., alanine, leucine, valine, isoleucine, glycine, methionine, aspartic acid, glutamic acid, lysine, arginine, asparagine, glutamine, serine, threonine, histidine, tyrosine, tryptophan, phenylalanine, cysteine, and proline), as well as, taurine, methyl taurine, dimethyl-glycine, diethyl-glycine, N-butyl-glycine, N-methyl-alanine, sarcosine, and mixtures thereof. Various formulations and processes for $CO_2$ capture from gas streams using solutions comprising amino acid compounds are known (see e.g., WO2011/014955A1). In one embodiment of the methods of $CO_2$ capture from a gas stream of the present disclosure, the suitable conditions comprise the presence of the amino acid compound sodium glycinate.

Generally, in the methods of the present disclosure, the solution comprises an aqueous solvent (water or aqueous co-solvent system) that may be pH buffered or unbuffered. Generally, the $CO_2$ absorption reaction via hydration of carbon dioxide can be carried out by the carbonic anhydrase polypeptides over a pH range of about pH 9 or above or at a pH of about pH 10 or above, usually in the range of from about 8 to about 12. During the course of both the hydration and the dehydration reactions, the pH of the reaction mixture may change. The pH of the reaction mixture may be maintained at a desired pH or within a desired pH range by the addition of an acid or a base during the course of the reaction. Alternatively, the pH may be controlled by using an aqueous solvent that comprises a buffer. Suitable buffers to maintain desired pH ranges are known in the art and include, for example, carbonate, HEPES, triethanolamine buffer, and the like. The ordinary artisan will recognize that other combinations of buffering and acid or base additions known in the art may also be used. In some embodiments, the methods can be carried out in a solution at a basic pH that thermodynamically and/or kinetically favors the solvation of $CO_2$—e.g., from about pH 8 to about pH 12. Accordingly, in some embodiments, the rate is determined at a pH of from about pH 8 to about pH 12, from about pH 9 to about pH 11.5, or from about pH 9.5 to pH 11. In other embodiments, release (dehydration) of captured carbon dioxide (e.g., as bicarbonate) is carried out at a pH of about 9 or below, usually in the range of from about pH 5 to about pH 9, or about pH 6 to about pH 9. In some embodiments, the dehydration is carried out at a pH of about 8 or below, often in the range of from about pH 6 to about pH 8.

In some embodiments, the methods of removing carbon dioxide from a gas stream disclosed herein, the solution can comprise an aqueous co-solvent system. For example, certain co-solvents or compounds can be added to the aqueous solution to reduce their degradative or corrosive properties. In some embodiments of the method, the solution is an aqueous co-solvent system comprising a ratio of water to a co-solvent from about 95:5 (v/v) to about 5:95 (v/v), in some embodiments, from about 90:10 (v/v) to about 10:90 (v/v), in some embodiments, from about 80:20 to about 20:80 (v/v), in some embodiments, from about 70:30 (v/v) to about 30:70 (v/v), and in some embodiments, from about 60:40 (v/v) to about 40:60 (v/v). The solvent component of an aqueous co-solvent system may be miscible with the aqueous component, providing a single liquid phase, or may be partly miscible or immiscible with the aqueous component, providing two liquid phases. The co-solvent system may be pre-formed prior to addition to the reaction mixture, or it may be formed in situ in the reaction vessel.

Co-solvent systems used in the methods typically comprise a solvent or compound that thermodynamically and/or kinetically favors the solvation of $CO_2$ from a gas-solvent interface. In some embodiments, the co-solvent in the aqueous solution is an amine compound (e.g., AMP, MDEA, MEA, TEA, and/or TIA). In some embodiments of the methods disclosed herein, the solution can comprise a mixture or blend of amine compounds, and/or other compounds that facilitate the absorption of $CO_2$ into the solution, e.g., ammonia, carbonate ions, strong base (e.g., NaOH), and/or compounds such as dimethyl ether of polyethylene glycol (PEG DME).

In some embodiments, the aqueous co-solvent systems can have water and one or more organic solvents. In general, an organic solvent component of an aqueous co-solvent system is selected such that it does not completely inactivate the chemically modified carbonic anhydrase enzyme. Appropriate co-solvent systems can be readily identified by measuring the enzymatic activity of the specified chemically modified carbonic anhydrase enzyme in the candidate solvent system, utilizing an enzyme activity assay, such as those described herein.

9. EXAMPLES

Various features and embodiments of the disclosure are illustrated in the following representative examples, which are intended to be illustrative, and not limiting.

Example 1

Preparation and Screening of Carbonic Anhydrase Polypeptides Based on Wild-Type Gene from *Desulfovibrio Vulgaris*

This example illustrates designing and optimizing the wild-type carbonic anhydrase gene from *Desulfovibrio vulgaris*, as well as further optimization and functional screening of the gene to generate engineered polypeptides having increased solvent and thermostability under conditions suitable for $CO_2$ absorption from gas into a capture solvent.

Gene acquisition, synthesis, cloning, and expression: The gene encoding a wild-type *Desulfovibrio vulgaris* carbonic anhydrase polypeptide of SEQ ID NO: 2 was codon-optimized for expression in *E. coli* as the nucleotide sequence of SEQ ID NO: 1. The codon-optimized gene of SEQ ID NO: 1 was synthesized using oligonucleotides, generally composed of 42 nucleotides, and cloned into the expression vector pCK110900 under the control of a lac promoter. This expression vector also contains the P15a origin of replication and the chloramphenicol resistance gene. Resulting plasmids containing the codon-optimized were transformed into *E. coli* W3110 using standard methods. The transformed wild-type gene sequence of SEQ ID NO: 1 was confirmed by standard sequencing techniques and the resultant expression of carbonic anhydrase activity by the transformed cells confirmed by high throughput activity assays as described below.

Preparation of engineered carbonic anhydrase library: Using the codon-optimized wild-type gene of SEQ ID NO: 1 as the starting point, a library of engineered variant genes was synthesized that targeted every residue from position X2 to position X223 of SEQ ID NO: 2 with substitutions of all 19 amino acids. The resulting engineered carbonic anhydrases polypeptide sequences, specific amino acid differences, and relative level of improvement are listed in Tables 2A and 2B.

Cloning of engineered carbonic anhydrase genes: As with the codon-optimized wild-type gene of SEQ ID NO: 1, the library of engineered variant genes was cloned into vector pCK110900 and expressed in *E. coli* W3110. Antibiotic resistant transformants were selected and processed to identify those expressing a CA with improved thermostability. Cell selection, growth, induced expression of CA variant enzymes and collection of cell pellets were as described below.

Picking: Recombinant *E. coli* colonies carrying a gene encoding CA were picked using a Q-Bot® robotic colony picker (Genetix USA, Inc., Boston, Mass.) into 96-well shallow well microtiter plates containing in each well 180 µL LB Broth, 1% glucose and 30 µg/mL chloramphenicol (CAM). Cells were grown overnight at 37° C. with shaking at 200 rpm. A 10 µL aliquot of this culture was then transferred into 96-deep well plates containing 390 µL TB broth and 30 µg/mL CAM. After incubation of the deep-well plates at 37° C. with shaking at 250 rpm for 2-3 hrs, recombinant gene expression within the cultured cells was induced by addition of IPTG to a final concentration of 1 mM, followed by addition of $ZnSO_4$ to a final concentration of 0.5 mM. The plates were then incubated at 37° C. with shaking at 250 rpm for 18 hrs.

Preparation of clear lysate for assay: Cells were pelleted by centrifugation (4000 RPM, 10 min, 4° C.), resuspended in 200 µL lysis buffer and lysed by shaking at room temperature for 2 hours. The lysis buffer contained 25 mM HEPES buffer, pH 8, 1 mg/mL lysozyme, and 500 µg/mL polymixin B sulfate (PMBS) and 1 mM dithiothreitol (DTT). After sealing the plates with aluminum/polypropylene laminate heat seal tape (Velocity 11, Menlo Park, Calif., Cat #06643-001), they were shaken vigorously for 2 hours at room temperature. Cell debris was pelleted by centrifugation (4000 RPM, 10 min., 4° C.) and the clear supernatant assayed directly or stored at 4° C. until use.

High-throughput screening for improved stability in amine solvent, MDEA: Screening of the polypeptides encoded by the variant genes for carbonic anhydrases with improved stability in high concentrations of an amine solvent, MDEA, was carried out using the assays as follows. After lysis, 25 µL of cleared *E. coli* lysate was added to 96-well Costar® shallow round bottom plate, followed by addition of 75 µL of amine solvent challenge buffer (4 M MDEA, pH 10; pH adjusted using $CO_2$ gas) using a Biomek NXp robotic instrument (Beckman Coulter, Fullerton, Calif.). The resulting challenge solution MDEA solvent concentration was 3 M. Challenge buffers with increased MDEA concentrations of 5.33 M and 6.66 M were used to generate 4 M and 5 M MDEA challenge solutions, which also were similarly adjusted to pH 10 with $CO_2$. The plates were heat-sealed with aluminum/polypropylene laminate heat seal tape (Velocity 11, Menlo Park, Calif., Cat #06643-001) at 175° C. for 2.5 seconds. The challenge reactions were heated for 24 h at the challenge temperature (42° C., 50° C., or 55° C.). Control reactions were maintained at 25° C. for 24 h. After 24 h, the plates were centrifuged at 4° C. for 10 min to clarify the reaction mixtures. Carbonic anhydrase activity after challenge was measured using a bicarbonate dehydration assay as follows: 10 µL of cleared reaction mixture was added to a 96-well NUNC™ polystyrene shallow flat bottom plate containing 190 µL of a solution of 0.3 M MDEA, pH 8 (pH adjusted with $CO_2$ gas), 200 mM $KHCO_3$, 400 µM phenolphthalein. The rate of the dehydration reaction was determined as the slope of absorbance change at 25° C. (or 45° C.) assay solution temperature monitored at 550 nm (phenolphthalein as indicator) over time (30 minutes) on a SpectraMax M2 reader (Molecular Devices, Sunnyvale, Calif.). Engineered carbonic anhydrase samples showing greater than 1.3-fold improvement in activity relative to the wild-type polypeptide of SEQ ID NO: 2 under the same challenge conditions (positive control) were retested in triplicate using the same conditions. As noted in Tables 2A, 2B, 2C, 2D, 2G, 2I, and 2J. HTP screening of engineered carbonic anhydrase polypeptides for amine solvent stability and thermostability has been carried out using at least seven different challenge conditions/assays. Assay 1: challenge for 24 h at 42° C. in 3 M MDEA solution followed by dehydration activity assay at 25° C.; Assay 2: challenge for 24 h at 50° C. in 3 M MDEA solution followed by dehydration activity assay at 25° C.; Assay 5: challenge for 24 h at 50° C. in 4 M MDEA solution followed by dehydration activity assay at 45° C.; Assay 6: challenge for 24 h at 50° C. in 5M MDEA solution followed by dehydration activity assay at 25° C.; Assay 7: challenge for 24 h at 55° C. in 5 M MDEA solution followed by dehydration activity assay at 25° C.; Assay 8: challenge for 24 h at 65° C. in 5 M MDEA solution followed by dehydration activity assay in 1 M MDEA, pH 8.0 at 45° C.; Assay 12: challenge for 24 h at 70° C. in 5 M MDEA solution followed by dehydration activity assay in 0.5 M MDEA at 45° C.; Assay 14: challenge for 24 h at 82.5° C. in 4.2 M MDEA solution followed by dehydration activity assay in 960 mM MDEA at 45° C.; Assay 15: challenge for 24 h at 85° C. in 4.2 M MDEA solution followed by dehydration activity assay in 960 mM MDEA at 45° C.; Assay 16: challenge for 24 h at 90° C. in 4.2 M MDEA solution followed by dehydration activity assay in 960 mM MDEA at 45° C.; and Assay 17: challenge for 24 h at 87° C. in 4.2 M MDEA solution followed by dehydration activity assay in 685 mM MDEA at 45° C. More stringent challenge conditions having higher amine solvent concentrations, and/or temperature, and/or additional reaction components (e.g., potential inhibiting impurities found in flue gas such as $NO_x$ and $SO_x$ compounds) are contemplated for screening further engineered carbonic anhydrase polypeptides having higher levels of stability and/or tolerance to the challenge conditions. High-throughput screening for improved stability in ammonia solvent: Screening of the engineered carbonic anhydrase polypeptides for improved stability in high concentrations of ammonia, was carried out using essentially the same HTP assay as for MDEA amine solvent described above but with the following changes. After lysis, 25 µl of lysate was transferred into 96-well Costar® shallow round bottom plates containing 75 µl of ammonia challenge buffer (5.6 M NH$_3$ (10 wt %) loaded with 0.3 molar equivalents of CO$_2$ gas). The resulting challenge solution ammonia concentration was 4.2 M (7.5 wt %). The challenge solutions were heated for 24 h at the challenge temperature (30° C. or 35° C.). Control solutions were maintained at 25° C. for 24 h. After 24 h under challenge conditions, carbonic anhydrase activity was measured using a bicarbonate dehydration assay as follows: 10 µl of challenge (or control) solution was transferred to 190 µl of buffer (100 mM HEPES buffer, pH 7; 200 mM KHCO$_3$, 400 µM phenolphthalein). The rate of the dehydration reaction was determined as the slope of absorbance change at 25° C. assay solution temperature monitored at 550 nm (phenolphthalein is a color indicator) over time (20 minutes). Engineered carbonic anhydrase samples showing greater than 1.3-fold improvement in activity relative to the wild-type polypeptide of SEQ ID NO: 2 under the same challenge conditions (positive control) were retested in triplicate using the same conditions.

As noted in Tables 2A, 2E, 2F, and 2H, HTP screening of engineered carbonic anhydrase polypeptides for ammonia solvent stability and thermostability has been carried out using at least six different challenge conditions/assays. Assay 3: challenge for 24 h at 30° C. in 4.2 M NH$_3$ solution containing 0.3 molar equivalents of CO$_2$ ($\alpha$=0.3), followed by dehydration activity assay at 25° C.; Assay 4: challenge for 24 h at 35° C. in 4.2 M NH$_3$ solution containing 0.3 molar equivalents of CO$_2$ ($\alpha$=0.3), followed by dehydration activity assay at 25° C.; Assay 9: challenge for 24 h at 44° C. in 5.6 M NH$_3$ solution containing 0.3 molar equivalents of CO$_2$ ($\alpha$=0.3), followed by dehydration activity assay in 0.28 M NH$_3$ at 25° C.; Assay 10: challenge for 24 h at 25° C. in 5.6 M NH$_3$ solution containing 0.3 molar equivalents of CO$_2$ ($\alpha$=0.3), followed by dehydration activity assay in 0.28 M NH$_3$ at 25° C.; Assay 11: challenge for 24 h at 58° C. in 8.4 M NH$_3$ solution containing 0.3 molar equivalents of CO$_2$ ($\alpha$=0.3), followed by dehydration activity assay in 1.37 M NH$_3$ at 25° C.; and Assay 13: challenge for 24 h at 70° C. in 8.4 M NH$_3$ solution containing 0.3 molar equivalents of CO$_2$ ($\alpha$=0.3), followed by dehydration activity assay at 25° C. More stringent challenge conditions having higher ammonia solvent concentrations, and/or higher or lower temperatures, and/or additional reaction components (e.g., potential inhibiting impurities found in flue gas such as NO$_x$ and SO$_x$ compounds) are contemplated for screening further engineered carbonic anhydrase polypeptides having higher levels of stability and/or tolerance to the challenge conditions.

Production of recombinant carbonic anhydrase shake-flask powder (SFP): A shake-flask procedure was used to generate recombinant carbonic anhydrase polypeptide powders used in secondary screening assays or in the carbon capture processes disclosed herein. Shake flask powder (SFP) includes approximately 30% total protein and accordingly provide a more purified preparation of an engineered enzyme as compared to the cell lysate. A single microbial colony of E. coli containing a plasmid encoding a CA of interest was inoculated into 50 mL Luria Bertani broth containing 30 µg/mL chloramphenicol and 1% glucose. Cells were grown overnight (at least 16 hrs) in an incubator at 30° C. with shaking at 250 rpm. The culture was diluted into 250 mL 2XYT media containing 30 µg/mL chloramphenicol, in a 1 liter flask to an optical density at 600 nm (OD$_{600}$) of 0.2 and allowed to grow at 30° C. Expression of the CA gene was induced by addition of isopropyl β D-thiogalactoside (IPTG) to a final concentration of 1 mM when the OD$_{600}$ of the culture was 0.6 to 0.8. ZnSO$_4$ was then added to a final concentration of 0.5 mM and incubation was then continued overnight (at least 16 hrs). Cells were harvested by centrifugation (5000 rpm, 15 min, 4° C.) and the supernatant discarded. The cell pellet was resuspended with an equal volume of cold (4° C.) 25 mM HEPES buffer, pH 8, and passed through a homogenizer twice at 33.6 kpsi while maintained at 4° C. Cell debris was removed by centrifugation (9000 rpm, 45 min., 4° C.). The clear lysate supernatant was collected and stored at -20° C. Lyophilization of frozen clear lysate provides a dry powder (shake flask powder) of recombinant carbonic anhydrase polypeptide.

Production of recombinant carbonic anhydrase downstream-processed (DSP) powder: DSP powders contains approximately 80% total protein and accordingly provide a more purified preparation of the engineered carbonic anhydrase as compared to the cell lysate. Larger-scale (~100-120 g) fermentation of the engineered carbonic anhydrase for production of DSP powders can be carried out as a short batch followed by a fed batch process according to standard bioprocess methods.

A single microbial colony of E. coli containing a plasmid with the recombinant carbonic anhydrase gene of interest was inoculated into 2 mL M9YE broth containing 30 µg/mL chloramphenicol and 1% glucose. Cells were grown overnight (at least 12 h) in an incubator at 37° C. with shaking at 250 rpm. After overnight growth, 0.5 mL of this culture was diluted into 250 mL M9YE Broth containing 30 µg/mL chloramphenicol and 1% glucose in 1 liter flask and allowed to grow at 37° C. with shaking at 250 rpm. When the OD$_{600}$ of the culture is 0.5 to 1.0, the cells were removed from the incubator and either used immediately, or stored at 4° C.

Bench-scale fermentations were carried out at 30° C. in an aerated, agitated 15 L fermentor using 6.0 L of growth medium consisting of: 0.88 g/L ammonium sulfate, 0.98 g/L of sodium citrate; 12.5 g/L of dipotassium hydrogen phosphate trihydrate, 6.25 g/L of potassium dihydrogen phosphate, 3.3 g/L of Tastone-154 yeast extract, 0.083 g/L ferric ammonium citrate, and 8.3 mL/L of a trace element solution containing 2 g/L of calcium chloride dihydrate, 2.2 g/L of zinc sulfate heptahydrate, 0.5 g/L manganese sulfate monohydrate, 1 g/L cuprous sulfate heptahydrate, 0.1 g/L ammonium molybdate tetrahydrate and 0.02 g/L sodium tetraborate. The vessel was sterilized at 121° C. and 15 PSI for 30 minutes, and ZnSO$_4$ was added to 0.5 mM post sterilization. The fermentor was inoculated with a late exponential culture of E. coli W3110 containing a plasmid encoding the CA gene of interest (grown in a shake flask as described above to a starting OD$_{600}$ of 0.5 to 1.0. The fermentor was agitated at 250-1250 rpm and air was supplied to the fermentation vessel at 0.6-25 L/min to maintain a dissolved oxygen level of 50% saturation or greater. The pH of the culture was maintained at 7.0 by addition of 20% v/v ammonium hydroxide. Growth of the culture was maintained by addition of a feed solution containing 500 g/L Cerelose dextrose, 12 g/L ammonium chloride and 5.1 g/L magnesium sulfate heptahydrate. After the culture reached an OD$_{600}$ of 70±10, expression of CA was induced by addition of isopropyl-β-D-thiogalactoside (IPTG) to a final concentration of 1 mM and fermentation is continued for another 18 hours. The culture was then chilled to 4° C. and maintained at that temperature until harvested. Cells were collected by centrifugation at 5000 G for 40 minutes in a Sorval RC12BP centrifuge at 4° C. Harvested cells were used directly in the following downstream recovery process or they may be stored at 4° C. or frozen at -80° C. until such use.

The cell pellet was resuspended in 2 volumes of 25 mM triethanolamine (sulfate) buffer, pH 7.5 at 4° C. to each volume of wet cell paste. The intracellular CA was released from the cells by passing the suspension through a homogenizer fitted with a two-stage homogenizing valve assembly using a pressure of 12000 psig. The cell homogenate was cooled to −20° C. immediately after disruption. A solution of 11% w/v polyethyleneimine pH 7.2 was added to the lysate to a final concentration of 0.5% w/v. A solution of 1 M $Na_2SO_4$ was added to the lysate to a final concentration of 100 mM. The lysate was then stirred for 30 minutes. The resulting suspension was clarified by centrifugation at 5000 G in a Sorval RC12BP centrifuge at 4° C. for 30 minutes. The clear supernatant was decanted and concentrated ten-fold using a cellulose ultrafiltration membrane with a molecular weight cut off of 10 kD. The final concentrate was dispensed into shallow containers, frozen at −20° C. and lyophilized to provide the DSP powder. The recombinant carbonic anhydrase DSP powder was stored at −80° C.

Example 2

Acceleration of $CO_2$ Absorption by the Carbonic Anhydrase from *Desulfovibrio Vulgaris* (SEQ ID NO: 2) in Presence of Various Amine Compounds and Carbonate Ions and Elevated Temperatures This example illustrates the ability of the wild-type beta-class carbonic anhydrase from *Desulfovibrio vulgaris* (SEQ ID NO: 2) and the engineered carbonic anhydrase polypeptides identified from HTP screening to accelerate the absorption of $CO_2$ gas into solutions containing high concentrations of various amine compounds (e.g., MDEA), or $Na_2CO_3$, as well as the amine compound MDEA at various elevated temperatures.

Stirred cell reactor apparatus: A stirred cell reactor (SCR) was used to measure the acceleration of $CO_2$ absorption rate in the presence of carbonic anhydrase polypeptides of the present disclosure. The SCR consists of a hermetically-sealed cylindrical reactor vessel in which a gas and a liquid phase are mixed while their interface remains flat resulting in a mass transfer rate that is well known. The SCR allows the gas pressure and the gas and liquid temperatures to be controlled and monitored over time.

SCR assay method: Carbonic anhydrase polypeptide shake-flask powder (DSP can also be used) and the $CO_2$ capture solution of interest (e.g., 4.2 M MDEA) are added to the reactor vessel. In some assays, the $CO_2$ capture solution is pre-loaded with a specific mole ratio of $CO_2$ per amine compound or ammonia defined by the term a. Pre-loading of a solution with $CO_2$ is carried out by first adding unloaded capture solution to the vessel, pressurizing the vessel with pure $CO_2$ gas and mixing the solution until the $CO_2$ pressure drops to a certain level. The difference between the highest pressure and lowest pressure is used (with the ideal gas law) to calculate a of the solution.

Following addition of enzyme and solution to the vessel, the pressure in the SCR is reduced until the boiling point is reached, and the system is allowed to equilibrate until the pressure and temperature no longer change. A reservoir containing $CO_2$ (pure or a mixture) is connected to the SCR and a connecting valve is opened briefly allowing $CO_2$ to enter the SCR. Typically, the valve is opened until there is a change in pressure of approximately 10 psi when pure $CO_2$ is used. After closing the connecting valve, the drop in pressure in the SCR, which corresponds to the capture of $CO_2$ in solution, is monitored over time along with the gas and liquid temperatures. A control assay without the enzyme is also carried out.

Calculation of rate acceleration: The slope of the logarithm of the pressure drop in the SCR over time is used to calculate the overall pseudo-first order rate constant ($k_{OV}$) according to Eq. 1.

$$\text{slope} = \frac{\Delta \ln P_{CO_2}}{\Delta t} = -\frac{RT_G A}{V_G He_{CO_2}} \sqrt{k_{OV} D_{CO_2}} \quad \text{(Eq. 1)}$$

From $k_{OV}$, the second order rate constant, $k_2$, can then be calculated according to Eq. 2.

$$r_{CO_2} = k_{OV}[CO_2], k_{OV} = k_{1,Base} + k_{1,CA} = k_{2,Base}[\text{Base}] + k_{2,CA}[CA] \quad \text{(Eq. 2)}$$

The acceleration provided by a carbonic anhydrase polypeptide, or $E_{Cat, X\ g/L}$, is calculated by dividing the rate, $k_{OV}$ measured with a specified amount (X g/L) of the carbonic anhydrase by the rate, $k_{OV}$ measured without enzyme, according to Eq. 3.

$$\text{Acceleration} = E_{Cat, X\ g/L} = \frac{k_{OV\ withX\ g/L\ carbonicanhydrase}}{k_{OV\ withoutcarbonicanhydrase}} \quad \text{(Eq. 3)}$$

Certain equations and physical constants are used in calculating $k_{OV}$. For Eq. 1 and Eq. 2 to be valid, the reaction must be operated in the pseudo first order regime, which requires the following conditions: Hatta number ("Ha")>2, and $E_\infty/Ha>5$ ($E_\infty$=infinite enhancement factor). The Hatta number, Ha, and infinite enhancement factor, $E_\infty$, are determined according to Eq. 4 and Eq. 5, respectively.

$$Ha = \frac{\sqrt{k_{OV} \cdot D_{CO_2}}}{k_L} \quad \text{(Eq. 4)}$$

$$E_\infty = \sqrt{\frac{D_{CO_2}}{D_{Base}}} + \sqrt{\frac{D_{Base}}{D_{CO_2}}} \cdot \frac{[\text{Base}] \cdot H_{CO_2}}{Z_{CO_2} \cdot P_{CO_2}} \quad \text{(Eq. 5)}$$

The physical constants used for SCR assays in solutions containing MDEA are summarized in Table 4.

TABLE 4

| | |
|---|---|
| Gas volume | 325 mL |
| Liquid volume | 175 mL |
| Interfacial area | $3.03 \times 10^{-3}\ m^2$ |
| Gas temperature | The average gas temperature during the part of the experiment where the slope is taken. |
| Liquid temperature | The average liquid temperature during the part of the experiment where the slope is taken. |
| Vapor pressure ($P_{vap}$) | Taken from the average of the first 10 pressure readings before the $CO_2$ valve is opened. Alternatively it can be calculated from: 133.3 * EXP(20.386 − 5130/T(K)) assuming water is the only compound giving a vapor pressure. |
| Liquid side mass transfer coefficient ($k_L$) | determined experimentally to be $4.47 \times 10^{-5}$ m/s (see e.g., Versteeg et al, Chem. Eng. Sci., 1987, 42, 1103-1119 for procedure). |
| Diffusivity of $CO_2$ ($D_{CO2}$) | Calculated as a function of liquid temperature and mass fraction of MDEA by the correlation given in Sandall et al, J. Chem. Eng. data 1989, 34, 385-391. |
| Diffusivity of MDEA ($D_{MDEA}$) | Calculated as a function of liquid temperature by the correlation given in Snijder et al., J. Chem. And Engi. Data, 1993, 38, 475-480. |
| Henry constant of $CO_2$ ($H_{CO2}$) | Calculated as a function of liquid temperature and mass fraction of MDEA by the correlation given in Sandall et al, J. Chem. Eng. data 1989, 34, 385-391. |
| Stoichiometric coefficient of $CO_2$ ($Z_{CO2}$) | 1 for the MDEA system. |

Results

As shown in Table 5, a loading of 1 g/L shake flask powder of the naturally occurring beta class carbonic anhydrase polypeptide of SEQ ID NO: 2 was capable of accelerating the absorption of $CO_2$ by solutions containing a range of amine solvents with no pre-loading of $CO_2$ ($\alpha$=0) at concentration ranges from 1 M up to 4.2 M. The observed amount of acceleration was greatest in the 1 M solutions and generally decreased with increasing amine concentration. However, even in 4.2 M MDEA, the acceleration relative to the rate without enzyme was 15.8.

TABLE 5

| [Amine] | Acceleration of $CO_2$ absorption Acceleration ($k_{OV,cat@1\ g/L}/k_{OV,uncat}$) | | | |
|---|---|---|---|---|
| (M) | MDEA | AMP | TEA | TIA |
| 1 | 52.3 | 4.15 | 49.8 | 95.1 |
| 2 | 27.1 | 1.54 | 43.3 | 85.1 |
| 3 | 22.4 | 1.23 | 14.5 | 16.1 |
| 4.2 | 15.8 | | | |

MDEA—Methyldiethanolamine
AMP—2-amino-2-methyl-1-propanol
TEA—Triethanolamine
TIA—Triisopropanolamine As shown in Table 6, a loading of 1 g/L shake-flask powder of the naturally occurring carbonic anhydrase polypeptide of SEQ ID NO: 2 was capable of accelerating the absorption of $CO_2$ by a solution at 25° C. containing 1 M $Na_2CO_3$ (with no pre-loading of $CO_2$). The initial level of acceleration was 142-fold increased relative to the control solution without the biocatalyst. The enzyme maintained a high level of acceleration at least 65-fold increased relative to no biocatalyst even after 7 days in the solution at 25° C.

TABLE 6

| 1 g/L SEQ ID NO: 2, 1M $Na_2CO_3$, 25° C. (no $CO_2$ pre-loaded) | |
|---|---|
| Time (h) | Acceleration |
| 0 | 142 |
| 19.95 | 119 |
| 45.64 | 110 |
| 95 | 71 |
| 168 | 65 |

Further SCR assays of the naturally occurring carbonic anhydrase polypeptide of SEQ ID NO: 2 were carried out at 40° C. in solutions pre-loaded with $CO_2$ ($\alpha$=0.1) and containing 0.5 g/L of the polypeptide and 2.0 to 4.2 M MDEA. The assay solutions were monitored for up to 49 h. As shown by the results listed in Table 7, only 0.5 g/L of the polypeptide of SEQ ID NO: 2 was capable of initially accelerating the absorption of $CO_2$ in solutions at 40° C. containing 2 M to 4.2 M MDEA from about 11-fold to about 3-fold relative to the control solution without biocatalyst added. Further even after 16 h or more in the 2 M to 4.2 M MDEA solutions at 40° C., the polypeptide of SEQ ID NO: 2 was capable of still accelerating $CO_2$ absorption by at least 2-fold relative to the control solution.

TABLE 7

| Assay Sample | Time (h) | $k_{OV}$ ($s^{-1}$) | Acceleration |
|---|---|---|---|
| 2M MDEA (no enzyme) | 0 | 10.8 | 1 |
| 2M MDEA + 0.5 g/L enzyme | 0 | 116.9 | 10.9 |
| 2M MDEA + 0.5 g/L enzyme | 20.4 | 30.2 | 2.8 |
| 2M MDEA + 0.5 g/L enzyme | 49.2 | 14.5 | 1.3 |
| 2.5M MDEA (no enzyme) | 0 | 12.6 | 1 |
| 2.5M MDEA + 0.5 g/L enzyme | 0 | 112.6 | 9.0 |
| 2.5M MDEA + 0.5 g/L enzyme | 21.1 | 38.4 | 3.1 |
| 2.5M MDEA + 0.5 g/L enzyme | 48.25 | 22.2 | 1.8 |
| 3M MDEA (no enzyme) | 0 | 15.0 | 1 |
| 3M MDEA + 0.5 g/L enzyme | 0 | 103.5 | 6.9 |
| 3M MDEA + 0.5 g/L enzyme | 19.92 | 37.5 | 2.5 |
| 3M MDEA + 0.5 g/L enzyme | 44.33 | 20.3 | 1.4 |
| 4.2M MDEA (no enzyme) | 0.0 | 12.4 | 1 |
| 4.2M MDEA + 0.5 g/L enzyme | 0.0 | 40.7 | 3.3 |
| 4.2M MDEA + 0.5 g/L enzyme | 16.5 | 28.2 | 2.3 |
| 4.2M MDEA + 0.5 g/L enzyme | 47.0 | 16.6 | 1.3 |

Example 3

Acceleration of $CO_2$ Absorption by Engineered Carbonic Anhydrase Polypeptides in the Presence of MDEA in Solution at Elevated Temperatures This example illustrates the ability of engineered carbonic anhydrase polypeptides identified from HTP screening to accelerate the absorption of $CO_2$ gas into amine solvent (MDEA) solutions at elevated temperatures.

Assays measuring rate of $CO_2$ hydration catalyzed by engineered carbonic anhydrase polypeptides of SEQ ID NO: 6, 16, 26, 30, 42, 84, and 186 (and wild-type of SEQ ID NO: 2) in MDEA solvent at 40° C. and 50° C. were carried out using the SCR and methods as described above in Example 2. As shown in Table 8, the relative improvement in stability in MDEA solvent exhibited by the polypeptides was determined as fold-improvement in residual activity at various time points and also as half-life ($t_{1/2}$) of $CO_2$ hydration activity.

TABLE 8

| Polypeptide SEQ ID NO: | Fold Improvement relative to SEQ ID NO: 2 | | | | | |
|---|---|---|---|---|---|---|
| | $t_{1/2}$ (h) | $t_{1/2}$ | Activity at 0 h | Residual Activity at 24 h | Residual Activity at 48 h | Residual Activity at 72 h |
| 0.5 g/L polypeptide, 3M MDEA, T = 40° C., $\alpha$ = 0.1 | | | | | | |
| 2 | 20.0 | 1 | 1 | 1 | 1 | 1 |
| 6 | 67.8 | 3.4 | 2.18 | 2.2 | 5.0 | 4.8 |
| 16 | 69.9 | 3.5 | 1.60 | 2.6 | 5.4 | 4.9 |
| 30 | 30.7 | 1.5 | 1.45 | 1.7 | 2.6 | 1.8 |
| 42 | 53.0 | 2.7 | 1.78 | 2.2 | 4.2 | 4.1 |
| 84 | 18.2 | 0.9 | 1.74 | 1.0 | 1.2 | 0.7 |
| 186 | 24.7 | 1.2 | 1.68 | 1.5 | 2.1 | 1.5 |
| 0.5 g/L polypeptide, 3M MDEA, T = 40° C., $\alpha$ = 0.02 | | | | | | |
| 2 | 32.0 | 1 | 1 | 1 | 1 | 1 |
| 6 | 132.1 | 4.1 | 1.20 | 2.0 | 2.7 | 2.8 |
| 16 | 153.7 | 4.8 | 1.02 | 2.0 | 2.7 | 2.6 |
| 30 | 82.8 | 2.6 | 1.03 | 1.8 | 2.7 | 2.6 |
| 42 | 88.6 | 2.8 | 1.13 | 1.4 | 2.2 | 2.3 |
| 84 | 27.6 | 0.9 | 1.10 | 0.9 | 1.0 | 0.8 |
| 186 | 45.5 | 1.4 | 1.06 | 1.2 | 1.6 | 1.1 |
| 0.5 g/L polypeptide, 3M MDEA, T = 50° C., $\alpha$ = 0.02 | | | | | | |
| 2 | 0.13 | 1.0 | | | | |
| 16 | 9.0 | 71.0 | | | | |
| 26 | 9.8 | 77.0 | | | | |

The engineered carbonic anhydrase polypeptides of SEQ ID NO: 6, 16, 30, 42, and 186 exhibited 1.2-fold to 4.8-fold increased stability in a 3 M MDEA solution at the elevated temperature of 40° C. (with a $CO_2$ loading $\alpha$=0.02 or 0.1) when measured as $t_{1/2}$ for $CO_2$ absorption activity relative to the wild-type polypeptide of SEQ ID NO: 2. At the further elevated temperature of 50° C. (with a $CO_2$ loading of $\alpha$=0.02) the engineered polypeptides of SEQ ID NO: 16 and 26 exhibited over 70-fold increased $t_{1/2}$ for $CO_2$ absorption activity in a 3 M MDEA solution relative to the wild type polypeptide of SEQ ID NO: 2.

The engineered carbonic anhydrase polypeptides of SEQ ID NO: 6, 16, 30, 42, and 186, continued to maintain their improved stability even at 48 h at 40° C. Additionally, in the case of the assays at the higher $CO_2$ loadings ($\alpha$=0.1), the stability increased significantly relative to that of the wild-type polypeptide of SEQ ID NO: 2—e.g., for SEQ ID NO: 16 increased from 1.6-fold to 5.4-fold greater than SEQ ID NO: 2.

Example 4

Acceleration of $CO_2$ Absorption by the Carbonic Anhydrase from *Desulfovibrio Vulgaris* (SEQ ID NO: 2) in Presence of Ammonia in Solution at Chilled Temperatures This example illustrates the ability of the beta-class carbonic anhydrase from *Desulfovibrio vulgaris* (SEQ ID NO: 2) to accelerate the absorption of $CO_2$ gas into a chilled ammonia solution.

Apparatus and Assay Method

To a Parr Series 5100 low pressure reactor system fitted with a mass flow meter, a digital pressure gauge, a septum-capped addition/sampling port, a thermal well, a cooling loop (used as baffles/agitator shaft support) and a 450 mL glass jacketed cylinder was added water and the water degassed via vacuum at room temperature for ~20-40 minutes (until no bubble formation was observed). The cylinder was detached under a gentle nitrogen flow and 30 wt % $NH_3$ solution was added to make up the desired $NH_3$ solution with a final volume of ~250 mL (e.g., 250 mL of 10 wt % $NH_3$ solution=166 mL of water and 83 mL of 30 wt % $NH_3$). The 450 mL glass jacketed cylinder with the $NH_3$ solution was reattached to the reactor under a nitrogen atmosphere and the internal temperature was adjusted to the desired level via an external heat exchanger/circulator.

The turbine propeller was positioned on the stirrer shaft such that it was slightly above the liquid level and was used to mix the gas phase. An egg-shaped stir bar was placed in the cylinder and was used to stir the liquid phase via an external stir plate situated underneath the cylinder. Typically, the gas phase was stirred at 1800-2000 rpm and the liquid phase was stirred at 900-1200 rpm (fastest rate such that the surface of the liquid remained relatively flat/ripple-free). The internal temperature of the gas phase, the internal temperature of the liquid phase, the internal gas phase pressure, the agitation rates and the jacket temperature were recorded via a data logger.

After the internal temperature and pressure had equilibrated/stabilized, $CO_2$ gas was introduced through the mass flow meter until the desired initial loading of $CO_2$ was obtained. Loading was denoted as "$\alpha$" which corresponds to the mole ratio of $CO_2$ to $NH_3$ (e.g., $\alpha$=0.3 means 3 moles of $CO_2$ per 10 moles of $NH_3$). Generally, depending on process optimization in an industrial scale process for $CO_2$ capture using chilled ammonia solution it is contemplated that the solution will enter the flue gas absorber at a relatively "lean" loading, of about $\alpha$=0.1-0.3 and after absorbing $CO_2$ will leave the absorber at a "rich" loading, dependent on equilibrium, of about $\alpha$=0.5-0.7.

Biocatalyst was introduced as an aqueous solution through the addition port. For control reaction, no additional solution was introduced. Then, for both sample and control reactions, a quick burst of $CO_2$ was added to the reactor vessel such that the partial pressure of $CO_2$ in the reactor was 5-15 psig. The vessel then was sealed. The subsequent decrease in the partial pressure of $CO_2$ in the reactor over time was recorded. The kinetic parameters were determined via analysis of the pressure versus time data under the prescribed reactor conditions. The composition of the solution in the reactor could also be monitored via samplings through the addition port. The acceleration in the rate of $CO_2$ absorption was calculated as described in Example 2.

Results

A set of assays were carried out at 10° C. in a solution containing 5.6 M $NH_3$ with and without 2 g/L of the naturally occurring beta class carbonic anhydrase of SEQ ID NO: 2, with the $CO_2$ loading of the solution varied from $\alpha$=0.30 to $\alpha$=0.62.

As shown in Table 9, the observed rate constants, $k_{ov}$, with and without enzyme decreased with increased $CO_2$ loading in the solution (i.e., increasing $\alpha$), but $k_{ov}$ increased as the $CO_2$ partial pressure in the gas phase decreased.

TABLE 9

| | $k_{ov}$ (s$^{-1}$) | | | |
| | $CO_2$ partial pressure drop (atm) | | | |
| Sample Loading | 0.2 → 0.15 | 0.15 → 0.10 | 0.10 → 0.05 | 0.05 → 0.02 |
|---|---|---|---|---|
| $\alpha$ = 0.30 + enzyme | 326 | 414 | 617 | 707 |
| $\alpha$ = 0.30 control | 110 | 137 | 179 | 193 |
| $\alpha$ = 0.36 + enzyme | 165 | 223 | 342 | 537 |
| $\alpha$ = 0.36 control | 33.0 | 43.3 | 58.8 | 89.8 |
| $\alpha$ = 0.41 + enzyme | 152 | 210 | 336 | 517 |
| $\alpha$ = 0.41 control | 14.4 | 17.4 | 23.6 | 32.4 |
| $\alpha$ = 0.47 + enzyme | 95 | 131 | 223 | 432 |
| $\alpha$ = 0.47 control | 5.3 | 7.4 | 13.6 | 33.5 |
| $\alpha$ = 0.53 + enzyme | 48 | 58 | 96 | 201 |
| $\alpha$ = 0.53 control | 3.1 | 3.5 | 3.5 | 2.5 |
| $\alpha$ = 0.62 + enzyme | 61 | 64 | 73 | 72 |
| $\alpha$ = 0.62 control | 3.8 | 4.4 | 6.1 | 11.3 |

As shown in Table 10, the naturally occurring carbonic anhydrase polypeptide of SEQ ID NO: 2 exhibited significant $CO_2$ absorption acceleration in the chilled ammonia solution (5.6 M $NH_3$ at 10° C.).

TABLE 10

| $CO_2$ Loading ($\alpha$) | Enzyme acceleration of $CO_2$ absorption |
|---|---|
| 0.30 | 3.0 |
| 0.36 | 5.5 |
| 0.41 | 13 |
| 0.47 | 17 |
| 0.53 | 22.5 |

The amount of acceleration by the presence of the polypeptide of SEQ ID NO: 2 increased linearly from a value of about 3.0, at a loading of $\alpha$=0.30, up to about 22.5, at a loading of $\alpha$=0.53. Above $\alpha$=0.53 the pseudo first order behavior of $k_{ov}$ appeared to break down and the rate of acceleration could not be determined accurately.

Further assays were carried out at 10° C. in a solution containing 5.6 M NH₃, a solution CO₂ loading of the solution of α=0.30-0.40 and 2 g/L of a recombinant carbonic anhydrase from Table 2A. The recombinant carbonic anhydrases polypeptides had amino acid sequences of SEQ ID NO: 6, 26, 32, 60, and 124, and included the following amino acid residue differences relative to SEQ ID NO 2: X15R, X30R; X56S, X86A, and X119K. All of the assayed recombinant carbonic anhydrases polypeptides accelerated the $CO_2$ absorption by the 5.6 M $NH_3$ solution at 10° C. equivalent to the acceleration exhibited by wild-type of SEQ ID NO: 2. In contrast, the wild-type carbonic anhydrases of SEQ ID NO: 1174, 1176, and 1178, each of which has some amino acid sequence homology to SEQ ID NO: 2 exhibited no observable acceleration over baseline of the $CO_2$ absorption by the 5.6 M $NH_3$ solution at 10° C. Thus, wild-type carbonic anhydrase polypeptide from *D. vulgaris* of SEQ ID NO: 2, or one of the engineered carbonic anhydrase polypeptides comprising one or more of the amino acid differences X15R, X30R; X56S, and X119K, is capable of significantly accelerating carbon dioxide absorption by a solution under "chilled ammonia" process conditions of 5.6 M $NH_3$, α=0.3-0.4, 2 g/L polypeptide, and T=10° C.

Example 5

Acceleration of $CO_2$ Absorption by Engineered Carbonic Anhydrase Polypeptides in the Presence of MDEA in Solution at Elevated Temperatures This example illustrates the ability of engineered carbonic anhydrase polypeptides identified from HTP screening to accelerate the absorption of $CO_2$ gas into amine solvent (MDEA) solutions at elevated temperatures.

Assays measuring rate of $CO_2$ hydration catalyzed by the engineered carbonic anhydrase polypeptides of SEQ ID NO: 26, 190, 206, 238, 252, 270, 274, 284, 306, 318, 328, 332, 340, 354, 596, 606, 656, 678, 1080, 1110, 1148, 1152, 1156, and 1158, in increasingly challenging conditions of MDEA solvent concentration and temperature, were carried out using the SCR and methods as described above in Example 2.

As shown in Tables 11-15, the relative improvement in stability in MDEA solvent exhibited by the polypeptides measured as half-life ($t_{1/2}$) of $CO_2$ hydration activity was determined as well as the fold-improvement in residual activity relative to a parent engineered polypeptide. For example, as shown in Table 15, the engineered carbonic anhydrase of SEQ ID NO: 1152 (which has the following residue differences relative to SEQ ID NO: 2: T30R; R31P;K37R; A40L; Q43M; A56S; E68A; V70I; A84Q; A95V; Q119M; G120R; H124R; T139M; N145F; H148T; V157A; M170F; N213E; and A219T) exhibited a 16-fold improvement in $t_{1/2}$ over its parent engineered polypeptide of SEQ ID NO: 656 (which has the following residue differences relative to SEQ ID NO: 2: T30R; K37R; A40L; A56S; E68A; A84Q; A95V; Q119M; G120R; T139M; N145W; N213E; A219T), under the following conditions: 1.0 g/L polypeptide, 4.2 M MDEA, T=50° C. assay, 75° C. incubation, α=0.02. Similarly, as shown in Table 14, the engineered carbonic anhydrase of SEQ ID NO: 656 exhibited a 10-fold improvement in $t_{1/2}$ over its parent engineered polypeptide of SEQ ID NO: 332 (which has the following residue differences relative to SEQ ID NO: 2: T30R, A40L, A56S, A84Q, G120R, and T139M), under the following conditions: 1.0 g/L polypeptide, 4.2 M MDEA, T=50° C. assay, 65° C. incubation, α=0.02. Hence, the results shown in this Example demonstrate the cumulative improvement for stability in the presence of an amine compound for the engineered carbonic anhydrase polypeptides through the addition of amino acid residue differences to the polypeptide sequences as disclosed herein.

TABLE 11

| Polypeptide SEQ ID NO: | $t_{1/2}$ (h) | Fold-improved (relative to SEQ ID NO: 26) |
|---|---|---|
| 0.5 g/L polypeptide, 4M MDEA, T = 50° C., α = 0.02 ||| 
| 26 | 9.1 | 1.00 |
| 328 | 57.4 | 6.31 |
| 284 | 48.1 | 5.29 |
| 354 | 41.2 | 4.53 |
| 318 | 37.4 | 4.11 |
| 340 | 25.2 | 2.77 |
| 252 | 18.4 | 2.02 |
| 190 | 5.7 | 0.63 |
| 206 | 24.3 | 2.67 |

TABLE 12

| Polypeptide SEQ ID NO: | $t_{1/2}$ (h) | Fold-improved (relative to SEQ ID NO: 26) |
|---|---|---|
| 1.0 g/L polypeptide, 4.2M MDEA, T = 53-55° C., α = 0.02 |||
| 26 | 0.59 | 1.0 |
| 332 | 10.3 | 17 |

TABLE 13

| Polypeptide SEQ ID NO: | $t_{1/2}$ (h) | Fold-improved (relative to SEQ ID NO: 26) |
|---|---|---|
| 1.0 g/L polypeptide, 4.2M MDEA, T = 53-55° C., α = 0.02 |||
| 332 | 23 | 1.0 |
| 270 | 55 | 2.4 |
| 238 | 44 | 1.9 |
| 306 | 78 | 3.4 |
| 274 | 119 | 5.1 |

TABLE 14

| Polypeptide SEQ ID NO: | $t_{1/2}$ (h) | Fold-improved (relative to SEQ ID NO: 26) |
|---|---|---|
| 1.0 g/L polypeptide, 4.2M MDEA, T = 50° C. assay, 65° C. incubation, α = 0.02 |||
| 332 | 2.8 | 1.0 |
| 656 | 28 | 10 |
| 596 | 21 | 7.6 |
| 606 | 81 | 29 |
| 678 | 27 | 9.8 |

TABLE 15

| Polypeptide SEQ ID NO: | $t_{1/2}$ (h) | Fold-improved (relative to SEQ ID NO: 26) |
|---|---|---|
| 1.0 g/L polypeptide, 4.2M MDEA, T = 50° C. assay, 75° C. incubation, α = 0.02 |||
| 656 | 2.2 | 1.0 |
| 1152 | 35 | 16 |
| 1156 | 24 | 11 |
| 1110 | 21 | 9.7 |
| 1158 | 17 | 7.9 |
| 1148 | 12 | 5.5 |
| 1080 | 12 | 5.3 |

Example 6

Acceleration of CO₂ Absorption by Engineered Carbonic Anhydrase Polypeptides in the Presence of NOₓ and SOₓ Flue Gas Components This example illustrates the ability of engineered carbonic anhydrase polypeptides identified from HTP screening to accelerate the absorption of $CO_2$ gas into amine solvent (MDEA) solutions in the presence of $NO_x$ and $SO_x$ compounds that are typical flue gas components.

A 1 g/L solution of the engineered carbonic anhydrase polypeptide of SEQ ID NO: 332 (which has the following amino acid differences relative to SEQ ID NO: 2: T30R, A40L, A56S, A84Q, G120R, and T139M) was added to 100 mL of 4.2 M MDEA, preloaded with $CO_2$ at a mole ratio of α=0.02, in the stirred cell reactor and allowed to equilibrate at 50° C. The enzyme activity was determined by pressurizing the system with pure $CO_2$ and measuring the rate of $CO_2$ pressure drop using the SCR and the overall rate constant $k_{ov}$ was calculated as described above in Example 2. After this initial baseline assay without any $NO_x$ or $SO_x$ compound was performed, 1 mL of 100 g/L NaNO₃ (sodium nitrate) was added at a concentration of 1 g/L (or 1 part per thousand, ppt) NaNO₃ in the SCR. NaNO₃ at 1 ppt was used to simulate a typical $NO_x$ compound flue gas component. The activity of the enzyme of SEQ ID NO: 332 was assayed as previously described. No loss of activity was observed due to the presence of NaNO₃. Then, 1 mL of 100 g/L NaNO₂ (sodium nitrite to simulate typical $NO_x$ flue gas component) was added to the same solution and again assayed. Similarly, these assays were repeated sequentially with Na₂SO₃ (sodium sulfite) and Na₂SO₄ (sodium sulfate).

As shown in the Table 16 below, at no point did there appear to be a significant change in the activity of the engineered carbonic anhydrase polypeptide of SEQ ID NO: 332 after the addition of any of the salts of $NO_x$ or $SO_x$. Hence, the improved activity of the engineered polypeptides of the present disclosure in accelerating the absorption of $CO_2$ in MDEA further exhibit resistance to inhibition by $NO_x$ or $SO_x$ compounds typically found as flue gas components.

TABLE 16

| Sample | Rate $k_{ov}$ (s⁻¹) |
| --- | --- |
| No enzyme | 44 |
| SEQ ID NO: 332 | 145 |
| SEQ ID NO: 332 + 1 ppt NaNO₃ | 144 |
| SEQ ID NO: 332 + 1 ppt NaNO₃ + 1 ppt NaNO₂ | 144 |
| SEQ ID NO: 332 + 1 ppt NaNO₃ + 1 ppt NaNO₂ + 1 ppt Na₂SO₃ | 133 |
| SEQ ID NO: 332 + 1 ppt NaNO₃ + 1 ppt NaNO₂ + 1 ppt Na₂SO₃ + 1 ppt Na₂SO₄ | 141 |

Example 7

Acceleration of CO₂ Absorption by Engineered Carbonic Anhydrase Polypeptides in the Presence of Ammonia This example further illustrates the ability of recombinant carbonic anhydrase polypeptides of the present disclosure to exhibit increased stability to ammonia and accelerate the absorption of $CO_2$ gas in solutions containing ammonia.

Uptake of $CO_2$ gas by solutions containing varying concentrations ammonia with and without enzyme were carried out in the stirred cell apparatus and using the assay protocol and general conditions described in Example 4.

As shown in Table 17, the recombinant carbonic anhydrase polypeptide of SEQ ID NO: 26 (which includes the amino acid difference A56S) accelerated the $CO_2$ gas uptake of a solution containing 8 M NH₃ at 5° C. The acceleration varied depending on the $CO_2$ loading (α) of the solution, ranging from about 1200 s⁻¹ at α=0.2 loading, down to about 15 s⁻¹ at α=0.5 loading.

As shown in Table 18, recombinant carbonic anhydrase polypeptides of SEQ ID NO: 32, 748, 788, 812, 962, 964, and 966, each of which have various amino acid residue differences relative to SEQ ID NO: 2, exhibit acceleration of $CO_2$ uptake relative to uncatalyzed solution in 10 wt % NH₃, (α=0.3) at 10° C., even after high temperature challenge of 24 h at 44° C. or 2 h at 65° C.

TABLE 17

| CO₂ loading (α) | Acceleration[1] [s⁻¹] |
| --- | --- |
| 0.20 | 1190.3 |
| 0.25 | 889.7 |
| 0.30 | 787.8 |
| 0.35 | 349.2 |
| 0.40 | 202.9 |
| 0.45 | 75.2 |
| 0.50 | 16.3 |
| 0.55 | 12.9 |

[1]"Acceleration" = $k_{ov}$ determined in stirred cell reactor using 2 g/L of polypeptide of SEQ ID NO: 26, 8M NH₃ at 5° C., over the CO₂ pressure drop range of from 0.15 atm to 0.10 atm.

TABLE 18

| No challenge | | After 24 h at 44° C. | | After 2 h at 65° C. | |
| --- | --- | --- | --- | --- | --- |
| SEQ ID NO: | Acceleration[1] | SEQ ID NO: | Acceleration[1] | SEQ ID NO: | Acceleration[1] |
| 966 | 3.1 | 966 | 2.3 | 748 | 1.4 |
| 32 | 3.0 | 962 | 2.3 | 962 | 1.3 |
| 812 | 3.0 | 964 | 2.0 | 964 | 1.3 |
| 962 | 3.0 | 812 | 1.8 | 966 | 1.2 |
| 964 | 2.9 | 788 | 1.7 | 788 | 1.2 |
| 788 | 2.7 | 748 | 1.6 | 812 | 1.1 |
| 748 | 1.7 | 32 | 1.4 | 32 | 1.0 |

[1]"Acceleration" = $k_{ov,cat}/k_{ov,uncat}$ where "$k_{ov,uncat}$" refers to the baseline rate of CO₂ uptake without enzyme present in 10 wt % NH₃, (α = 0.3) at 10° C.

Example 8

Increased Acceleration of CO₂ Absorption by Glutaraldehyde-Treated α-Class, β-Class, and Engineered Carbonic Anhydrases in MDEA Solution This example illustrates the preparation of chemically modified versions of the wild-type α-class human ("HuCAII") carbonic anhydrase polypeptide of SEQ ID NO: 1298, the wild-type β-class *Desulfovibrio vulgaris* carbonic anhydrase polypeptide of SEQ ID NO: 2, and the engineered β-class derived from *Desulfovibrio vulgaris* carbonic anhydrase polypeptides of SEQ ID NO: 656 and 1152 of the present disclosure, by treatment with glutaraldehyde. The example also illustrates ability of the glutaraldehyde-modified enzyme to exhibit equivalent or increased activity and stability in accelerating the absorption of $CO_2$ gas in a solution containing $CO_2$ absorption mediating compound MDEA.

Preparation of chemically modified carbonic anhydrase polypeptides: Shake-flask powder preparations of each of the carbonic anhydrase polypeptides were dissolved at 10 g/L concentration in 50 mM TEA-SO$_4$buffer at pH 7.7, or in 50 mM Na$_2$CO$_3$ buffer at pH 10. A 25% aqueous solution of glutaraldehyde (Sigma-Aldrich Cat. #G6257; Sigma-Aldrich Corp., St. Louis, USA) was added directly to the carbonic anhydrase polypeptide solution to give the desired final glutaraldehyde concentration (e.g., 0.25% v/v). The polypeptide and cross-linking agent solutions were mixed then allowed to incubate at room temperature without mixing for 1-4 h. The resulting solutions comprising the glutaraldehyde treated carbonic anhydrase polypeptide composition were slightly yellow in color and very slightly cloudy. Cloudiness was removed by centrifugation prior to assay.

Preparation of chemically modified carbonic anhydrase formulations in MDEA and SCR assay of activity: After incubation, 10 mL of the chemically modified carbonic anhydrase polypeptide solution was added to 90 mL of 4.66 M MDEA solution (not pre-loaded with CO$_2$). The resulting formulation of 1 g/L chemically modified carbonic anhydrase had a final MDEA concentration of 4.2 M. The formulation of chemically modified carbonic anhydrase polypeptide in 4.2 M MDEA was assayed for rate of CO$_2$ absorption at 50° C. in the SCR using the assay protocol and general conditions described in Example 2.

Briefly, the SCR assay was carried out as follows: the solution was heated until it reached 50° C.; the pressure in the SCR was reduced until the solution just started boiling, the valve to the vacuum pump was then closed; the temperature and pressure in the SCR was allowed to equilibrate; pure CO$_2$ was added to the SCR until it reached about 10 psia total pressure, after which the valve to the CO$_2$ source was closed; the pressure drop and gas and liquid temperatures were recorded; $k_{OV}$ is calculated from the slope of ln P vs t. $k_{1,CA}$ can be calculated by subtracting $k_{OV}$ without carbonic anhydrase from $k_{OV}$ with carbonic anhydrase.

Results: As shown in Table 19 below, the chemically modified carbonic anhydrase polypeptides resulting from treatment with cross-linking agent glutaraldehyde exhibited increased carbonic anhydrase activity ($k_{OV}$) relative to the same carbonic anhydrase polypeptides that were not treated with the cross-linking agent (i.e., "unmodified") when assayed in 4.2 M MDEA at 50° C. The human α-class carbonic anhydrase of SEQ ID NO: 1298 when chemically modified with glutaraldehyde (GA), exhibited the largest fold-improvement (14-fold) relative to its unmodified form. The *Desulfovibrio vulgaris* wild-type β-class carbonic anhydrase polypeptide of SEQ ID NO: 2, and the two engineered β-class carbonic anhydrase polypeptides of SEQ ID NO: 656 and 1152 all exhibited higher activity upon chemical modification by glutaraldehyde treatment, with significant improvements of 1.9-fold, 2.7-fold, and 5.0-fold, relative to the unmodified enzymes. Each of these β-class enzymes also exhibited greater overall activity in the assay than the α-class enzyme.

TABLE 19

| Sample | Acceleration $k_{OV}$ (s$^{-1}$) | Fold-Improved (relative to unmodified) |
|---|---|---|
| Water | 32 | n/a |
| SEQ ID NO: 1298 (HuCAII) (unmodified) | 38 | n/a |
| SEQ ID NO: 1298 (HuCAII) + GA treatment | 117 | 14 |

TABLE 19-continued

| Sample | Acceleration $k_{OV}$ (s$^{-1}$) | Fold-Improved (relative to unmodified) |
|---|---|---|
| SEQ ID NO: 2 (unmodified) | 151 | n/a |
| SEQ ID NO: 2 + GA treatment | 261 | 1.9 |
| SEQ ID NO: 656 (unmodified) | 208 | n/a |
| SEQ ID NO: 656 + GA treatment | 503 | 2.7 |
| SEQ ID NO: 1152 (unmodified) | 154 | n/a |
| SEQ ID NO: 1152 + GA treatment | 643 | 5.0 |

Example 9

Increased Stability of CO$_2$ Absorption Acceleration in MDEA by a Thermally Challenged Glutaraldehyde-Treated Engineered Carbonic Anhydrase This example illustrates that a recombinant carbonic anhydrase polypeptide of the present disclosure that has been chemically modified by treatment with the cross-linking agent glutaraldehyde exhibits increased stability to thermal challenge in 4.2 M MDEA in its ability to accelerate the absorption of CO$_2$.

Assay for increased stability: The engineered β-class carbonic anhydrase polypeptide of SEQ ID NO: 1152 was chemically modified by treatment with 0.25% glutaraldehyde and assayed in SCR to determine the $k_{OV}$ for CO$_2$ uptake acceleration as described in Example 8. The heat challenge used to determine increased stability was carried out as follows. The sample was removed from the SCR and put into a bottle. The bottle was quickly heated to the stability challenge temperature of 75° C. and incubated in an oven set to this temperature. For the next assay point, the solution was quickly cooled to the 50° C. assay temperature and assay in the SCR as above. This was repeated as necessary over a 13 day period to provide the time course for loss of stability at 75° C.

Results: The results were plotted as time of heat challenge at 75° C. versus normalized activity ($k_1$) over the course of 13 days. As shown in FIG. 1, the plots both exhibited logarithmic decreases in activity over time but the rate of loss of activity in the chemically modified carbonic anhydrase was significantly decreased (indicating greater stability). The unmodified CA lost nearly 80% of its activity by the end of the first day, whereas the chemically modified CA had lost only to 25% of its activity. Based on a comparison of the line fits of the plots of all the data out to 12.5 days, the engineered β-class carbonic anhydrase polypeptide of SEQ ID NO: 1152 after chemical modification by glutaraldehyde treatment is about 4-fold more stable than the same engineered β-class carbonic anhydrase polypeptide of SEQ ID NO: 1152 that is unmodified.

Example 10

Increased Acceleration of CO$_2$ Absorption by a Glutaraldehyde-Treated Carbonic Anhydrase in the CO$_2$ Absorption Mediating Compound Solutions: AMP, MDEA, TEA, and Carbonate This example illustrates the ability of the recombinant carbonic anhydrase polypeptides of the present disclosure that are chemically modified by treatment with glutaraldehyde to exhibit increased activity in accelerating the absorption of $CO_2$ by solutions containing $CO_2$ absorption mediating compounds other than MDEA including AMP, TEA, and carbonate ion.

The engineered carbonic anhydrase of SEQ ID NO: 1152 was chemically modified with 0.25% GA as described in Example 8. The chemically modified and unmodified polypeptides were then assayed in the SCR at 50° C. without pre-loading of $CO_2$ as described in Example 8, in solutions including the following concentrations of $CO_2$ absorption mediating compounds: 2 M AMP; 3 M TEA; and 2 M $K_2CO_3$.

Results: As shown in Table 20 below. In 2 M AMP, the unmodified CA showed no activity in this solvent, in contrast, the GA modified CA did show activity and was ~4-fold higher compared to the solvent alone. In TEA, the GA modified CA was ~1.6-fold compared to TEA with unmodified CA. In 2 M $K_2CO_3$, no improvement was observed with the GA modified CA compared to the unmodified CA (significant precipitation was observed with the GA modified CA compared to the unmodified CA in $K_2CO_3$).

TABLE 20

| Sample | Activity $k_{OV}$ ($s^{-1}$) | Fold-Improved (relative to unmodified) |
|---|---|---|
| 2M AMP | | |
| Water | 1,400 | |
| SEQ ID NO: 1152 (unmodified) | 1,400 | |
| SEQ ID NO: 1152 + GA treatment | 4,200 | ~4 |
| 3M TEA | | |
| Water | 10 | |
| SEQ ID NO: 1152 (unmodified) | 71 | |
| SEQ ID NO: 1152 + GA treatment | 110 | ~1.6 |
| 2M $K_2CO_3$ | | |
| Water | 39 | |
| SEQ ID NO: 1152 (unmodified) | 110 | |
| SEQ ID NO: 1152 + GA treatment | 110 | 1.0 |
| 4.2M MDEA | | |
| Water | 32 | |
| SEQ ID NO: 1152 (unmodified) | 150 | |
| SEQ ID NO: 1152 + GA treatment | 640 | ~4.3 |

Example 11

Increased Acceleration of $CO_2$ Absorption by a Glutaraldehyde-Treated Carbonic Anhydrase in the $CO_2$ Absorption Mediating Compound Solution: Ammonia This example illustrates the ability of a wild-type β-class carbonic anhydrase polypeptide of that is chemically modified by treatment with glutaraldehyde to exhibit increased activity in accelerating the absorption of $CO_2$ by a solution containing the $CO_2$ absorption mediating compound, ammonia.

The wild-type *Desulfovibrio vulgaris* β-class carbonic anhydrase polypeptide of SEQ ID NO: 2 was chemically modified by treatment with 0.5% glutaraldehyde (GA) in 100 mM TEA sulfate buffer, pH 8.5 at 25 g/L CA concentration for 1-3 hrs. After the GA treatment, the solution was centrifuged to remove very slight precipitation that appeared in both GA modified and unmodified enzyme solutions. Using the stirred cell reactor (SCR) the kinetics of $CO_2$ absorption was measured without the enzyme present ("water"), with the carbonic anhydrase that was not chemically modified (unmodified), and with the GA-modified carbonic anhydrase. These SCR assays were performed at 22° C. in 1 M and 2 M ammonia with loading from 0.1 to 0.3. Activity was measured as pressure drop over time and calculated as the square of the natural logarithm of the pressure drop with time, which is proportional to the pseudo-first order kinetic constant, $k_{OV}$.

Results: As shown in Table 21 below, the GA modified CA exhibited 1.4 to 4.4-fold improved activity depending on the concentration and loading of $CO_2$ in the solution.

TABLE 21

| Sample | Activity $(\ln\Delta P/\Delta t)^2 \times 10^4$ | Fold-Improved (relative to unmodified) |
|---|---|---|
| 1M $NH_4OH$ (α = 0.1) | | |
| Water | 0.952 | |
| SEQ ID NO: 2 (unmodified) | 2.21 | |
| SEQ ID NO: 2 + GA treatment | 4.55 | 2.9 |
| 2M $NH_4OH$ (α = 0.1) | | |
| Water | 1.67 | |
| SEQ ID NO: 2 (unmodified) | 3.63 | |
| SEQ ID NO: 2 + GA treatment | 4.36 | 1.4 |
| 2M $NH_4OH$ (α = 0.2) | | |
| Water | 2.50 | |
| SEQ ID NO: 2 (unmodified) | 3.31 | |
| SEQ ID NO: 2 + GA treatment | 6.02 | 4.4 |
| 2M $NH_4OH$ (α = 0.3) | | |
| Water | 1.01 | |
| SEQ ID NO: 2 (unmodified) | 2.36 | |
| SEQ ID NO: 2 + GA treatment | 3.24 | 1.6 |

Example 12

Increased Acceleration of $CO_2$ Absorption in the $CO_2$ Absorption Mediating Compound Solution MDEA by a Recombinant Carbonic Anhydrase Treated with Either of the Cross-linking Agents Dimethyl Suberimidate or Dimethyl Pimelimidate This example illustrates the ability of the recombinant carbonic anhydrase polypeptides of the present disclosure that are chemically modified by treatment with the cross-linking agents dimethyl suberimidate and dimethyl pimelimidate to exhibit increased activity in accelerating the absorption of $CO_2$ by a solution containing the $CO_2$ absorption mediating compound MDEA.

Preparation and assay of chemically modified carbonic anhydrase polypeptides: Shake-flask powder preparations of the recombinant carbonic anhydrase of SEQ ID NO: 1152 were chemically modified by treatment with either of the cross-linking agents dimethyl suberimidate (Sigma-Aldrich Corp., St. Louis, USA) or dimethyl pimelimidate (Sigma-Aldrich Corp., St. Louis, USA) according to the same method used for glutaraldehyde treatment in Example 8, except that instead of glutaraldehyde either of dimethyl suberimidate or dimethyl pimelimidate was added as a solid to the polypeptide solution to give the desired final concentration of crosslinking agent. Two different treatment concentrations were used for each of dimethyl suberimidate and dimethyl pimelimidate: 0.25% and 2.5%.

Activity was determined by SCR assay of 1 g/L chemically modified enzyme in a solution 4.2 M MDEA, unloaded with $CO_2$ at 50° C. Stability of the chemically modified enzymes was also determined by measuring residual activity after 21 hours of incubation at 75° C. in the same assay solvent.

Results: As shown in Table 22 below, for both the DM-suberimidate and DM-pimelimidate cross-linking agents under both treatment conditions, the chemically modified β-class carbonic anhydrase polypeptide of SEQ ID NO: 1152 exhibited increased carbonic anhydrase activity relative to the same enzyme that was not chemically modified in an initial assay. After 21 h of incubation at 75° C. in the same assay solution, the enzymes chemically modified with dimethyl suberimidate and dimethyl pimelimidate no longer exhibited improved carbonic anhydrase activity compared to the unmodified enzyme. Thus, treatment with these cross-linking agents did not result in increased enzyme stability based on a 21 hour incubation at 75° C. This apparent lack of increased stability is not unexpected as both dimethyl suberimidate and dimethyl pimelimidate are known to result base labile cross-links that likely are cleaved during the challenge resulting in a loss of any stabilizing effect due to chemical modification that results in cross links.

TABLE 22

| Sample | Initial Activity $k_{1,CA}$ ($s^{-1}$) | Activity $k_1$ after challenge (21 h, 75° C.) ($s^{-1}$) |
|---|---|---|
| SEQ ID NO: 1152 (unmodified) | 193 | 113 |
| SEQ ID NO: 1152 + 0.25% DM-Suberimidate treatment | 501 | 131 |
| SEQ ID NO: 1152 + 2.5% DM-Suberimidate treatment | 231 | 134 |
| SEQ ID NO: 1152 + 0.25% DM-Pimelimidate treatment | 411 | 118 |
| SEQ ID NO: 1152 + 2.5% DM-Pimelimidate treatment | 303 | 113 | that are chemically modified by treatment with the base stable cross-linking agent suberic acid bis(N-hydroxysuccinimide) to exhibit increased activity and stability in accelerating the absorption of $CO_2$ by a solution containing the $CO_2$ absorption mediating compound MDEA.

The recombinant carbonic anhydrase of SEQ ID NO: 1152 was chemically modified by treatment with either 0.25% or 2.5% concentrations of the cross-linking agent suberic acid bis(N-hydroxysuccinimide). The chemically modified enzyme was assayed for carbonic anhydrase activity at 1 g/L in 4.2 M MDEA, unloaded with $CO_2$ at 50° C.

Preparation and assay of chemically modified carbonic anhydrase polypeptides: Shake-flask powder preparations of the recombinant carbonic anhydrase of SEQ ID NO: 1152 were chemically modified by treatment with the cross-linking agent suberic acid bis(N-hydroxysuccinimide) (Sigma-Aldrich Corp., St. Louis, USA) according to the same method used for glutaraldehyde treatment in Example 8, except that suberic acid bis(N-hydroxysuccinimide) ("suberic-NHS") was added as a solid to the polypeptide solution and was mixed during the 1-4 hour incubation period. Two different treatment concentrations of suberic-NHS were used: 0.25% and 2.5%.

Results: As shown in Table 23 below, there was a slight increase in the initial carbonic anhydrase activity for the sample solution of the carbonic anhydrase polypeptide of SEQ ID NO: 1152 modified with a 0.25% concentration of the cross-linking agent but no significant activity increase for the 2.5% sample. The sample modified with 2.5% cross-linking agent, however, exhibited no significant loss of activity after 23 h and 46 h incubation in the assay solvent at 75° C. In contrast, the same carbonic anhydrase polypeptide when unmodified showed 45 and 43% residual activity after 23 and 46 h (in the same solvent) and the 0.25% sample showed 58 and 41% residual activity in the same time frame and solvent. Thus, treatment with 2.5% of the suberic-NHS cross-linking agent results in a chemically modified enzyme with increased stability.

TABLE 23

| Sample | Initial Activity $k_{1,CA}$ ($s^{-1}$) (% residual activity) | Activity $k_{1,CA}$ ($s^{-1}$) after 23 h challenge at 75° C. (% residual activity) | Activity $k_{1,CA}$ ($s^{-1}$) after 46 h challenge at 75° C. (% residual activity) | Activity $k_{1,CA}$ ($s^{-1}$) after 115 h challenge at 75° C. (% residual activity) |
|---|---|---|---|---|
| SEQ ID NO: 1152 (unmodified) | 147 (100%) | 66 (45%) | 63 (43%) | 16 (11%) |
| SEQ ID NO: 1152 + 0.25% Suberic NHS treatment | 211 (100%) | 122 (58%) | 86 (41%) | 40 (19%) |
| SEQ ID NO: 1152 + 2.5% Suberic NHS treatment | 154 (100%) | 157 (102%) | 145 (94%) | 36 (24%) |

Example 13

Increased Acceleration and Stability of $CO_2$ Absorption in the $CO_2$ Absorption Mediating Compound Solution MDEA by a Recombinant Carbonic Anhydrase Treated with the Base-Stable Cross-Linking Agent Suberic Acid Bis(N-hydroxysuccinimide)

This example illustrates the ability of the recombinant carbonic anhydrase polypeptides of the present disclosure All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (1308 sequences)

SEQ ID NO: 1 - DNA, 672 bp, Artificial Sequence
  Codon-optimized carbonic anhydrase gene from Desulfovibrio vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 2 - protein, 223 aa, Desulfovibrio vulgaris str. "Miyazaki F"
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 3 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 4 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 5 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 6 - protein, 223 aa, Artificial Sequence
  Engineered variant of carbonic anhydrase from D. vulgaris
MGSTGPGIGPDEALQRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 7 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 8 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 9 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaagggcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 10 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 11 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcaacgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 12 - protein, 223 aa, Artificial Sequence
  Engineered variant of carbonic anhydrase from D. vulgaris
MGSTGPGIGPDEALQRLKEGNARFVAETPQRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 13 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 14 - protein, 223 aa, Artificial Sequence
  Engineered variant of carbonic anhydrase from D. vulgaris
MGSFGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 15 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgcaaacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 16 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 17 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 18 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVMGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 19 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaaccattctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 20 - protein, 223 aa, Artificial Sequence
  Engineered variant of carbonic anhydrase from D. vulgaris
MGSTGPGIGPDEALQRLKEGNARFVAETPTRQNHSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 21 - DNA, 672 bp, Artificial Sequence
  Engineered variant of carbonic anhydrase from D. vulgaris
atgggtagcatgggaccgggaattggaccagacgaagctttacagcgtcttaaggaaggaaatgctagatttgtagccgaaacacctaaacgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 22 - protein, 223 aa, Artificial Sequence
  Engineered variant of carbonic anhydrase from D. vulgaris
MGSMGPGIGPDEALQRLKEGNARFVAETPKRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 23 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgacacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 24 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 25 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 26 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 27 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtaaaaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 28 - protein, 223 aa, Artificial Sequence
  Engineered variant of carbonic anhydrase from D. vulgaris
MGSTGPGIGPDEALQRLKEGNARFVAETPTRKNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 29 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttacttgcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 30 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLLAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 31 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 32 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 33 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 34 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSWPKHDRAALVPKVIEANVWQAIDDTMRQSPIIRARVAAGKLKVVGAIYHIDDGKVEWLGEHPMQARLLNYTSGPAKAHR

SEQ ID NO: 35 - DNA, 672 bp, Artificial Sequence
  Engineered variant of carbonic anhydrase from D. vulgaris
atgggtagcacgggaccgggaattggaccagacgaagctttacagagtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 36 - protein, 223 aa, Artificial Sequence
  Engineered variant of carbonic anhydrase from D. vulgaris
MGSTGPGIGPDEALQSLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 37 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 38 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 39 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 40 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLEYTSGPAKAHR

SEQ ID NO: 41 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgtcgctaa

SEQ ID NO: 42 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 43 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtattgaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 44 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVLKSNPKHDRAALVPKVIEANVWQAIDDTMRQSPIIRARVAAGKLKVVGAIYHIDDGKVEWLGEHPMQARLLNYTSGPAKAHR

SEQ ID NO: 45 - DNA, 672 bp, Artificial Sequence
  Engineered variant of carbonic anhydrase from D. vulgaris
atgacaagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 46 - protein, 223 aa, Artificial Sequence
  Engineered variant of carbonic anhydrase from D. vulgaris
MTSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 47 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccacagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 48 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 49 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagttgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 50 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKLNPKHDRAALVPKVIEANVWQAIDDTMRQSPIIRARVAAGKLKVVGAIYHIDDGKVEWLGEHPMQARLLNYTSGPAKAHR

SEQ ID NO: 51 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatccatgcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 52 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIHANVWQAIDDTMRQSPIIRARVAAGKLKVVGAIYHIDDGKVEWLGEHPMQARLLNYTSGPAKAHR

SEQ ID NO: 53 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtacaagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 54 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVQAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 55 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaaacagaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 56 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKTDRAALVPKVIEANVWQAIDDTMRQSPIIRARVAAGKLKVVGAIYHIDDGKVEWLGEHPMQARLLNYTSGPAKAHR

SEQ ID NO: 57 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 58 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTFRQSPIIRARVAAGKLKVVGAIYHIDDGKVEWLGEHPMQARLLNYTSGPAKAHR

SEQ ID NO: 59 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagcagaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 60 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATAEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 61 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggaaaagaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 62 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGKEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 63 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagctttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 64 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSFPKHDRAALVPKVIEANVWQAIDDTMRQSPIIRARVAAGKLKVVGAIYHIDDGKVEWLGEHPMQARLLNYTSGPAKAHR

SEQ ID NO: 65 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcgtaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 66 - protein, 223 aa, Artificial Sequence
  Engineered variant of carbonic anhydrase from D. vulgaris
MGSTGPGIGPDEALQRLKEGNARFVAETPTRRNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 67 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggatgggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 68 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGWEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 69 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaggcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 70 - protein, 223 aa, Artificial Sequence
  Engineered variant of carbonic anhydrase from D. vulgaris
MGSTGPGIGPDEALQRLKEGNARFVAETPTRQNLSARRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 71 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgtcaccgctaa

SEQ ID NO: 72 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 73 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgagtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 74 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVASTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 75 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagctcaccgctaa

SEQ ID NO: 76 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVRWLGEHPMQARLLNYTSGPAKAHR

SEQ ID NO: 77 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaaaagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 78 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVKAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 79 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagttgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 80 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 81 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgaatacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 82 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVANTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 83 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctatgcatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 84 - protein, 223 aa, Artificial Sequence
  Engineered variant of carbonic anhydrase from D. vulgaris
MGSTGPGIGPDEALQRLKEGNARFVAETPTRQNLSAKRLATSMHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 85 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagttgaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 86 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGVEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 87 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgggtcacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 88 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPGHDRAALVPKVIEANVWQAIDDTMRQSPIIRARVAAGKLKVVGAIYHIDDGKVEWLGEHPMQARLLNYTSGPAKAHR

SEQ ID NO: 89 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgttaa

SEQ ID NO: 90 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 91 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctgcacgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 92 - protein, 223 aa, Artificial Sequence
  Engineered variant of carbonic anhydrase from D. vulgaris
MGSTGPGIGPDEALQRLKEGNARFVAETPARQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 93 - DNA, 672 bp, Artificial Sequence
  Engineered variant of carbonic anhydrase from D. vulgaris
atgcgtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 94 - protein, 223 aa, Artificial Sequence
  Engineered variant of carbonic anhydrase from D. vulgaris
MRSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 95 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggacatgaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 96 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGHEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 97 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggacaagaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 98 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGQEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 99 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagatgtccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 100 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRCPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 101 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagcctgtcaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 102 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGACHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 103 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctttgcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 104 - protein, 223 aa, Artificial Sequence
  Engineered variant of carbonic anhydrase from D. vulgaris
MGSTGPGIGPDEALQRLKEGNARFVAETPLRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 105 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgttgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 106 - protein, 223 aa, Artificial Sequence
  Engineered variant of carbonic anhydrase from D. vulgaris
MGSTGPGIGPDEALQRLKEGNARFVAETPTRQNLSAKRLLTSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 107 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 108 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADFLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 109 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgcaggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 110 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDAGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 111 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcacaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctactaaagctcaccgctaa

SEQ ID NO: 112 - protein, 223 aa, Artificial Sequence
  Engineered variant of carbonic anhydrase from D. vulgaris
MGSTGPGIGPDEALQRLKEGNARFVAETPTRQNLSAKRLATAQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPTKAHR

SEQ ID NO: 113 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcattggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 114 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGIGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 115 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaacaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 116 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVTGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 117 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 118 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGAEHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 119 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttagcagcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 120 - protein, 223 aa, Artificial Sequence
  Engineered variant of carbonic anhydrase from D. vulgaris
MGSTGPGIGPDEALQRLKEGNARFVAETPTRQNLAAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 121 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtaggtggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 122 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVGGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 123 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaaaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 124 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVKGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 125 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcattgacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 126 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPALTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 127 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgaaacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 128 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDETMRQSPIIRARVAAGKLKVVGAIYHIDDGKVEWLGEHPMQARLLNYTSGPAKAHR

SEQ ID NO: 129 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtacatgctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 130 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVHAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 131 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggaacagaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 132 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGTEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 133 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggattggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 134 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGLEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 135 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaaggcaaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 136 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKANPKHDRAALVPKVIEANVWQAIDDTMRQSPIIRARVAAGKLKVVGAIYHIDDGKVEWLGEHPMQARLLNYTSGPAKAHR

SEQ ID NO: 137 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagctgtccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 138 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSCPKHDRAALVPKVIEANVWQAIDDTMRQSPIIRARVAAGKLKVVGAIYHIDDGKVEWLGEHPMQARLLNYTSGPAKAHR

SEQ ID NO: 139 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcaatacacatctggacctgctaaagctcaccgctaa

SEQ ID NO: 140 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLQYTSGPAKAHR

SEQ ID NO: 141 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccaaacaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 142 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGAKHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 143 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagaggtcgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 144 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRGRVAAGKLKVVGAIYHIDDGKVEWLGEHPMQARLLNYTSGPAKAHR

SEQ ID NO: 145 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacgtggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 146 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVRGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 147 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgcacaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 148 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGAAHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 149 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttacgtgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 150 - protein, 223 aa, Artificial Sequence
  Engineered variant of carbonic anhydrase from D. vulgaris
MGSTGPGIGPDEALQRLKEGNARFVAETPTRQNLRAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 151 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgttgcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 152 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIVANVWQAIDDTMRQSPIIRARVAAGKLKVVGAIYHIDDGKVEWLGEHPMQARLLNYTSGPAKAHR

SEQ ID NO: 153 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaaggccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 154 - protein, 223 aa, Artificial Sequence
  Engineered variant of carbonic anhydrase from D. vulgaris
MGSTGPGIGPDEALQRLKEGNARFVAETPTRQNLSAKRLATSQHGQRPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 155 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaagcagaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 156 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKADRAALVPKVIEANVWQAIDDTMRQSPIIRARVAAGKLKVVGAIYHIDDGKVEWLGEHPMQARLLNYTSGPAKAHR

SEQ ID NO: 157 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgaggacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 158 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVARTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 159 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctgttcatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 160 - protein, 223 aa, Artificial Sequence
  Engineered variant of carbonic anhydrase from D. vulgaris
MGSTGPGIGPDEALQRLKEGNARFVAETPTRQNLSAKRLATSVHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 161 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatccgtgcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 162 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIRANVWQAIDDTMRQSPIIRARVAAGKLKVVGAIYHIDDGKVEWLGEHPMQARLLNYTSGPAKAHR

SEQ ID NO: 163 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgtttcacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 164 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPFHDRAALVPKVIEANVWQAIDDTMRQSPIIRARVAAGKLKVVGAIYHIDDGKVEWLGEHPMQARLLNYTSGPAKAHR

SEQ ID NO: 165 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacggtggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 166 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDGGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 167 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggcaatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 168 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKAIEANVWQAIDDTMRQSPIIRARVAAGKLKVVGAIYHIDDGKVEWLGEHPMQARLLNYTSGPAKAHR

SEQ ID NO: 169 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcatggacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 170 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAWTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 171 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcatttacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 172 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAFTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 173 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccaataa

SEQ ID NO: 174 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHQ

SEQ ID NO: 175 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccagaacaggctcgattactgaactacacatctggacctgctaaagctcaccgctaa

SEQ ID NO: 176 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPEQARLLNYTSGPAKAHR

SEQ ID NO: 177 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgaaaacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 178 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAKTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 179 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagttccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 180 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRVPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 181 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgcaaacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 182 - protein, 223 aa, Artificial Sequence
  Engineered variant of carbonic anhydrase from D. vulgaris
MGSTGPGIGPDEALQRLKEGNARFVAETPTRQNLSAKRLQTSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 183 - DNA, 672 bp, Artificial Sequence
  Engineered variant of carbonic anhydrase from D. vulgaris
atgggtagcacgggaccgggaattggaccagacgaagctttacagcgtcttaaggaaggaaatggtagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 184 - protein, 223 aa, Artificial Sequence
  Engineered variant of carbonic anhydrase from D. vulgaris
MGSTGPGIGPDEALQRLKEGNGRFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 185 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagatgagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaaatcaggctcgattactgaactacacatctggacctgctaaagctcaccgctaa

SEQ ID NO: 186 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEMSNPKHDRAALVPKVIEANVWQAIDDTMRQSPIIRARVAAGKLKVVGAIYHIDDGKVEWLGEHPNQARLLNYTSGPAKAHR

SEQ ID NO: 187 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 188 - protein, 223 aa, Artificial Sequence
  Engineered variant of carbonic anhydrase from D. vulgaris
MGSTGPGIGPDEALQRLKEGNARFVAETPRPQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 189 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 190 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 191 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 192 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 193 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 194 - protein, 223 aa, Artificial Sequence
  Engineered variant of carbonic anhydrase from D. vulgaris
MGSTGPGIGPDEALQRLKEGNARFVAETPTPQNLSAKRLLTSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 195 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 196 - protein, 223 aa, Artificial Sequence
  Engineered variant of carbonic anhydrase from D. vulgaris
MGSTGPGIGPDEALQRLKEGNARFVAETPRPQNLSAKRLATSQHGQTPYATILSCSDSRAPVELIFDEGVGDLFVIRVAGNVAQTDEVGTAEYGADHLNVPLLVVMGHTQCGAVTAVVMGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 197 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 198 - protein, 223 aa, Artificial Sequence
  Engineered variant of carbonic anhydrase from D. vulgaris
MGSTGPGIGPDEALQRLKEGNARFVAETPTPQNLSAKRLLTSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 199 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcagccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 200 - protein, 223 aa, Artificial Sequence
  Engineered variant of carbonic anhydrase from D. vulgaris
MGSTGPGIGPDEALQRLKEGNARFVAETPQPQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 201 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcagcgtcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 202 - protein, 223 aa, Artificial Sequence
  Engineered variant of carbonic anhydrase from D. vulgaris
MGSTGPGIGPDEALQRLKEGNARFVAETPQRQNHSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 203 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 204 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 205 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 206 - protein, 223 aa, Artificial Sequence
  Engineered variant of carbonic anhydrase from D. vulgaris
MGSTGPGIGPDEALQRLKEGNARFVAETPRPQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 207 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 208 - protein, 223 aa, Artificial Sequence
  Engineered variant of carbonic anhydrase from D. vulgaris
MGSFGPGIGPDEALQRLKEGNARFVAETPTRQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 209 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 210 - protein, 223 aa, Artificial Sequence
  Engineered variant of carbonic anhydrase from D. vulgaris
MGSTGPGIGPDEALQRLKEGNARFVAETPRRQNHSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 211 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 212 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 213 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctaccccgcagaaccattctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 214 - protein, 223 aa, Artificial Sequence
  Engineered variant of carbonic anhydrase from D. vulgaris
MTSTGPGIGPDEALQRLKEGNARFVAETPTPQNHSAKRLLTSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 215 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctacccgtcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 216 - protein, 223 aa, Artificial Sequence
  Engineered variant of carbonic anhydrase from D. vulgaris
MGSFGPGIGPDEALQRLKEGNARFVAETPTRQNHSAKRLATSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVTAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 217 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 218 - protein, 223 aa, Artificial Sequence
  Engineered variant of carbonic anhydrase from D. vulgaris
MGSTGPGIGPDEALQRLKEGNARFVAETPTRQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 219 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 220 - protein, 223 aa, Artificial Sequence
  Engineered variant of carbonic anhydrase from D. vulgaris
MGSTGPGIGPDEALQRLKEGNARFVAETPTPQNLSAKRLLTSQHGQTPYATILSCSDSRAPVELIFDEGVGDLFVIRVAGNVAATDEVGTAEYGADHLNVPLLVVMGHTQCGAVTAVVMRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 221 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 222 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVTAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 223 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 224 - protein, 223 aa, Artificial Sequence
  Engineered variant of carbonic anhydrase from D. vulgaris
MGSFGPGIGPDEALQRLKEGNARFVAETPTRQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 225 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 226 - protein, 223 aa, Artificial Sequence
  Engineered variant of carbonic anhydrase from D. vulgaris
MGSTGPGIGPDEALQRLKEGNARFVAETPTPQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 227 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 228 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 229 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 230 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 231 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcagcgtcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 232 - protein, 223 aa, Artificial Sequence
  Engineered variant of carbonic anhydrase from D. vulgaris
MGSTGPGIGPDEALQRLKEGNARFVAETPQRQNHSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 233 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 234 - protein, 223 aa, Artificial Sequence
  Engineered variant of carbonic anhydrase from D. vulgaris
MGSTGPGIGPDEALQRLKEGNARFVAETPTRQNHSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 235 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 236 - protein, 223 aa, Artificial Sequence
  Engineered variant of carbonic anhydrase from D. vulgaris
MGSTGPGIGPDEALQRLKEGNARFVAETPRPQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 237 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 238 - protein, 223 aa, Artificial Sequence
  Engineered variant of carbonic anhydrase from D. vulgaris
MGSTGPGIGPDEALQRLKEGNARFVAETPRRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 239 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 240 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 241 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 242 - protein, 223 aa, Artificial Sequence
  Engineered variant of carbonic anhydrase from D. vulgaris
MGSFGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 243 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 244 - protein, 223 aa, Artificial Sequence
  Engineered variant of carbonic anhydrase from D. vulgaris
MTSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 245 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 246 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 247 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 248 - protein, 223 aa, Artificial Sequence
  Engineered variant of carbonic anhydrase from D. vulgaris
MTSTGPGIGPDEALQRLKEGNARFVAETPTRQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 249 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtactgcgagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 250 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVLRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 251 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 252 - protein, 223 aa, Artificial Sequence
  Engineered variant of carbonic anhydrase from D. vulgaris
MGSTGPGIGPDEALQRLKEGNARFVAETPTRQNLSAKRLLTSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 253 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 254 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 255 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 256 - protein, 223 aa, Artificial Sequence
  Engineered variant of carbonic anhydrase from D. vulgaris
MGSTGPGIGPDEALQRLKEGNARFVAETPTRQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVMAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 257 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 258 - protein, 223 aa, Artificial Sequence
  Engineered variant of carbonic anhydrase from D. vulgaris
MGSTGPGIGPDEALQRLKEGNARFVAETPTRQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 259 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctcagcgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 260 - protein, 223 aa, Artificial Sequence
  Engineered variant of carbonic anhydrase from D. vulgaris
MGSFGPGIGPDEALQRLKEGNARFVAETPQRQNLSAKRLATSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 261 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 262 - protein, 223 aa, Artificial Sequence
  Engineered variant of carbonic anhydrase from D. vulgaris
MGSTGPGIGPDEALQRLKEGNARFVAETPTRQNHSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 263 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 264 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 265 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 266 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 267 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 268 - protein, 223 aa, Artificial Sequence
  Engineered variant of carbonic anhydrase from D. vulgaris
MGSTGPGIGPDEALQRLKEGNARFVAETPRPQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 269 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcagcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 270 - protein, 223 aa, Artificial Sequence
  Engineered variant of carbonic anhydrase from D. vulgaris
MGSTGPGIGPDEALQRLKEGNARFVAETPQRQNLSAKRLLTSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 271 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 272 - protein, 223 aa, Artificial Sequence
  Engineered variant of carbonic anhydrase from D. vulgaris
MGSTGPGIGPDEALQRLKEGNARFVAETPTRQNLSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVTAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 273 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaaccattctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 274 - protein, 223 aa, Artificial Sequence
  Engineered variant of carbonic anhydrase from D. vulgaris
MGSTGPGIGPDEALQRLKEGNARFVAETPRPQNHSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 275 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgggagcggaggtacatggatcaatcccgatgttagtggcgccgattgtgcctgcagtaatggctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 276 - protein, 223 aa, Artificial Sequence
  Engineered variant of carbonic anhydrase from D. vulgaris
MGSTGPGIGPDEALQRLKEGNARFVAETPTPQNLSAKRLLTSQHGQTPYATILSCSDSRAPVELIFDEGVGDLFVIRVAGNVAATDEVGTAEYGADHLNVPLLVVMGHTQCGAVTAVVMGAEVHGSIPMLVAPIVPAVMAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 277 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 278 - protein, 223 aa, Artificial Sequence
  Engineered variant of carbonic anhydrase from D. vulgaris
MTSTGPGIGPDEALQRLKEGNARFVAETPTRQNLSAKRLLTSQHGQTPYATILSCSDSRAPVELIFDEGVGDLFVIRVAGNVAATDEVGTAEYGADHLNVPLLVVMGHTQCGAVTAVVMRAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 279 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctcagcgtcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgggagcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 280 - protein, 223 aa, Artificial Sequence
  Engineered variant of carbonic anhydrase from D. vulgaris
MTSTGPGIGPDEALQRLKEGNARFVAETPQRQNHSAKRLATSQHGQTPYATILSCSDSRAPVELIFDEGVGDLFVIRVAGNVAATDEVGTAEYGADHLNVPLLVVMGHTQCGAVTAVVMGAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 281 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 282 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 283 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 284 - protein, 223 aa, Artificial Sequence
  Engineered variant of carbonic anhydrase from D. vulgaris
MGSTGPGIGPDEALQRLKEGNARFVAETPTRQNHSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVMAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 285 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 286 - protein, 223 aa, Artificial Sequence
  Engineered variant of carbonic anhydrase from D. vulgaris
MGSTGPGIGPDEALQRLKEGNARFVAETPTPQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 287 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaaaagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 288 - protein, 223 aa, Artificial Sequence
  Engineered variant of carbonic anhydrase from D. vulgaris
MGSTGPGIGPDEALQRLKEGNARFVAETPTRQNLSAKRLLTSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVMAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 289 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctcagcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 290 - protein, 223 aa, Artificial Sequence
  Engineered variant of carbonic anhydrase from D. vulgaris
MTSTGPGIGPDEALQRLKEGNARFVAETPQRQNLSAKRLLTSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 291 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 292 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 293 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctcagcgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 294 - protein, 223 aa, Artificial Sequence
  Engineered variant of carbonic anhydrase from D. vulgaris
MGSFGPGIGPDEALQRLKEGNARFVAETPQRQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 295 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcagcgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 296 - protein, 223 aa, Artificial Sequence
  Engineered variant of carbonic anhydrase from D. vulgaris
MGSTGPGIGPDEALQRLKEGNARFVAETPQRQNLSAKRLATSQHGQTPYATILSCSDSRAPVELIFDEGVGDLFVIRVAGNVAQTDEVGTAEYGADHLNVPLLVVMGHTQCGAVTAVVMRAEVHGSIPMLVAPIVPAVMAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 297 - DNA, 672 bp, Artificial Sequence
  Engineered variant of carbonic anhydrase from D. vulgaris
atgaccagctttggaccgggaattggaccagacgaagctttacagcgtcttaaggaaggaaatgctagatttgtagccgaaacacctcagccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 298 - protein, 223 aa, Artificial Sequence
  Engineered variant of carbonic anhydrase from D. vulgaris
MTSFGPGIGPDEALQRLKEGNARFVAETPQPQNLSAKRLLTSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 299 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 300 - protein, 223 aa, Artificial Sequence
  Engineered variant of carbonic anhydrase from D. vulgaris
MGSFGPGIGPDEALQRLKEGNARFVAETPTRQNLSAKRLLTSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 301 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctcgtcgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 302 - protein, 223 aa, Artificial Sequence
  Engineered variant of carbonic anhydrase from D. vulgaris
MTSTGPGIGPDEALQRLKEGNARFVAETPRRQNLSAKRLATSQHGQTPYATILSCSDSRAPVELIFDEGVGDLFVIRVAGNVAATDEVGTAEYGADHLNVPLLVVMGHTQCGAVTAVVMGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 303 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 304 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 305 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 306 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 307 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 308 - protein, 223 aa, Artificial Sequence
  Engineered variant of carbonic anhydrase from D. vulgaris
MGSFGPGIGPDEALQRLKEGNARFVAETPTRQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 309 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 310 - protein, 223 aa, Artificial Sequence
  Engineered variant of carbonic anhydrase from D. vulgaris
MGSTGPGIGPDEALQRLKEGNARFVAETPRPQNLSAKRLATSQHGQTPYATILSCSDSRAPVELIFDEGVGDLFVIRVAGNVAATDEVGTAEYGADHLNVPLLVVMGHTQCGAVTAVVMRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 311 - DNA, 672 bp, Artificial Sequence
  Engineered variant of carbonic anhydrase from D. vulgaris
atgaccagctttggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgcgagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 312 - protein, 223 aa, Artificial Sequence
  Engineered variant of carbonic anhydrase from D. vulgaris
MTSFGPGIGPDEALQRLKEGNARFVAETPTRQNLSAKRLLTSQHGQTPYATILSCSDSRAPVELIFDEGVGDLFVIRVAGNVAATDEVGTAEYGADHLNVPLLVVMGHTQCGAVTAVVMRAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 313 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 314 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAQTDEVGTAEYGADHLNVPLLVVMGHTQCGAVTAVVMGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 315 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 316 - protein, 223 aa, Artificial Sequence
  Engineered variant of carbonic anhydrase from D. vulgaris
MTSTGPGIGPDEALQRLKEGNARFVAETPTRQNLSAKRLLTSQHGQTPYATILSCSDSRAPVELIFDEGVGDLFVIRVAGNVAATDEVGTAEYGADHLNVPLLVVMGHTQCGAVTAVVMRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 317 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 318 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 319 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctcagccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 320 - protein, 223 aa, Artificial Sequence
  Engineered variant of carbonic anhydrase from D. vulgaris
MGSFGPGIGPDEALQRLKEGNARFVAETPQPQNLSAKRLATSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 321 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcagccgcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 322 - protein, 223 aa, Artificial Sequence
  Engineered variant of carbonic anhydrase from D. vulgaris
MGSTGPGIGPDEALQRLKEGNARFVAETPQPQNHSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 323 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctcagccgcagaaccattctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgggagcggaggtacatggatcaatcccgatgttagtggcgccgattgtgcctgcagtaatggctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 324 - protein, 223 aa, Artificial Sequence
  Engineered variant of carbonic anhydrase from D. vulgaris
MGSFGPGIGPDEALQRLKEGNARFVAETPQPQNHSAKRLLTSQHGQTPYATILSCSDSRAPVELIFDEGVGDLFVIRVAGNVAATDEVGTAEYGADHLNVPLLVVMGHTQCGAVTAVVMGAEVHGSIPMLVAPIVPAVMAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 325 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 326 - protein, 223 aa, Artificial Sequence
  Engineered variant of carbonic anhydrase from D. vulgaris
MGSTGPGIGPDEALQRLKEGNARFVAETPTRQNHSAKRLATSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVTAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 327 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 328 - protein, 223 aa, Artificial Sequence
  Engineered variant of carbonic anhydrase from D. vulgaris
MTSTGPGIGPDEALQRLKEGNARFVAETPTRQNLSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 329 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 330 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 331 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 332 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 333 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 334 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 335 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 336 - protein, 223 aa, Artificial Sequence
  Engineered variant of carbonic anhydrase from D. vulgaris
MGSTGPGIGPDEALQRLKEGNARFVAETPTPQNHSAKRLATSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 337 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaaccattctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 338 - protein, 223 aa, Artificial Sequence
  Engineered variant of carbonic anhydrase from D. vulgaris
MGSTGPGIGPDEALQRLKEGNARFVAETPTPQNHSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVMAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 339 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 340 - protein, 223 aa, Artificial Sequence
  Engineered variant of carbonic anhydrase from D. vulgaris
MTSTGPGIGPDEALQRLKEGNARFVAETPRRQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 341 - DNA, 672 bp, Artificial Sequence
  Engineered variant of carbonic anhydrase from D. vulgaris
atgaccagcacgggaccgggaattggaccagacgaagctttacagcgtcttaaggaaggaaatgctagatttgtagccgaaacacctcgtcgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 342 - protein, 223 aa, Artificial Sequence
  Engineered variant of carbonic anhydrase from D. vulgaris
MTSTGPGIGPDEALQRLKEGNARFVAETPRRQNLSAKRLATSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVMAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 343 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 344 - protein, 223 aa, Artificial Sequence
  Engineered variant of carbonic anhydrase from D. vulgaris
MGSTGPGIGPDEALQRLKEGNARFVAETPRRQNLSAKRLATSQHGQTPYATILSCSDSRAPVELIFDEGVGDLFVIRVAGNVAATDEVGTAEYGADHLNVPLLVVMGHTQCGAVTAVVMRAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 345 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctcagcgtcagaaccattctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 346 - protein, 223 aa, Artificial Sequence
  Engineered variant of carbonic anhydrase from D. vulgaris
MGSFGPGIGPDEALQRLKEGNARFVAETPQRQNHSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 347 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaaccattctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgggagcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 348 - protein, 223 aa, Artificial Sequence
  Engineered variant of carbonic anhydrase from D. vulgaris
MGSTGPGIGPDEALQRLKEGNARFVAETPRPQNHSAKRLLTSQHGQTPYATILSCSDSRAPVELIFDEGVGDLFVIRVAGNVAQTDEVGTAEYGADHLNVPLLVVMGHTQCGAVTAVVMGAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 349 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctacccgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 350 - protein, 223 aa, Artificial Sequence
  Engineered variant of carbonic anhydrase from D. vulgaris
MGSFGPGIGPDEALQRLKEGNARFVAETPTRQNLSAKRLLTSQHGQTPYATILSCSDSRAPVELIFDEGVGDLFVIRVAGNVAATDEVGTAEYGADHLNVPLLVVMGHTQCGAVTAVVMRAEVHGSIPMLVAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 351 - DNA, 672 bp, Artificial Sequence
  Engineered variant of carbonic anhydrase from D. vulgaris
atgaccagctttggaccgggaattggaccagacgaagctttacagcgtcttaaggaaggaaatgctagatttgtagccgaaacacctcgtccgcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 352 - protein, 223 aa, Artificial Sequence
  Engineered variant of carbonic anhydrase from D. vulgaris
MTSFGPGIGPDEALQRLKEGNARFVAETPRPQNHSAKRLATSQHGQTPYATILSCSDSRAPVELIFDEGVGDLFVIRVAGNVAATDEVGTAEYGADHLNVPLLVVMGHTQCGAVTAVVQRAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 353 - DNA, 672 bp, Artificial Sequence
  Engineered variant of carbonic anhydrase from D. vulgaris
atgggtagctttggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 354 - protein, 223 aa, Artificial Sequence
  Engineered variant of carbonic anhydrase from D. vulgaris
MGSFGPGIGPDEALQRLKEGNARFVAETPRRQNLSAKRLLTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 355 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 356 - protein, 223 aa, Artificial Sequence
  Engineered variant of carbonic anhydrase from D. vulgaris
MGSTGPGIGPDEALQRLKEGNARFVAETPTPQNHSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 357 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaaccattctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgggagcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 358 - protein, 223 aa, Artificial Sequence
  Engineered variant of carbonic anhydrase from D. vulgaris
MGSTGPGIGPDEALQRLKEGNARFVAETPTRQNHSAKRLLTSQHGQTPYATILSCSDSRAPVELIFDEGVGDLFVIRVAGNVAQTDEVGTAEYGADHLNVPLLVVMGHTQCGAVTAVVMGAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 359 - DNA, 672 bp, Artificial Sequence
  Engineered variant of carbonic anhydrase from D. vulgaris
atgaccagctttggaccgggaattggaccagacgaagctttacagcgtcttaaggaaggaaatgctagatttgtagccgaaacacctacccgtcagaaccattctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaacagctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 360 - protein, 223 aa, Artificial Sequence
  Engineered variant of carbonic anhydrase from D. vulgaris
MTSFGPGIGPDEALQRLKEGNARFVAETPTRQNHSAKRLATSQHGQTPYATILSCSDSRAPVELIFDEGVGDLFVIRVAGNVAQTDEVGTAEYGADHLNVPLLVVMGHTQCGAVTAVVMRAEVHGSIPMLVAPIVPAVTAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 361 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagctggccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 362 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVTAVEKSWPTHDRAALVPKVIEANVWQAIDDTMRQSPIIRARVAAGKLKVVGAIYHIDDGKVEWLGEHPMQARLLNYTSGPAKAHR

SEQ ID NO: 363 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtacaggctgtagagaagagcctgccgaaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 364 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVQAVEKSLPKHDRAALVPKVIVANVWQAIDDTMRQSPIIRARVAAGKLKVVGAIYHIDDGKVEWLGEHPMQARLLNYTSGPAKCHR

SEQ ID NO: 365 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtacaggctgtagagaagagctggccgaaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 366 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVQAVEKSWPKHDRAALVPKVIVANVWQAIDDTMRQSPIIRARVAAGKLKVVGAIYHIDDGKVEWLGEHPMQARLLEYTSGPAKAHR

SEQ ID NO: 367 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 368 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLEYTSGPAKAHR

SEQ ID NO: 369 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaaaagctgtagagaagagctttccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 370 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVKAVEKSFPEHDRAALVPKVIEANVWQAIDDTMRQSPIIRARVAAGKLKVVGAIYHIDDGKVEWLGEHPMQARLLNYTSGPAKAHR

SEQ ID NO: 371 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttatttgcgccgattgtgcctgcagtaaaagctgtagagaagagcaacccggaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 372 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGVDHLNVPLLVVMGHTQCGAVTAVVQGAEVHGSIPMLFAPIVPAVKAVEKSNPEHDRAALVPKVIVANVWQAIDDTMRQSPIIRARVAAGKLKVVGAIYHIDDGKVEWLGEHPMQARLLEYTSGPAKAHR

SEQ ID NO: 373 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttatttgcgccgattgtgcctgcagtaacagctgtagagaagagcaacccggaacacgaccgcgcggctttagtgccgaaggtgatccatgcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 374 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLFAPIVPAVTAVEKSNPEHDRAALVPKVIHANVWQAIDDTMRQSPIIRARVAAGKLKVVGAIYHIDDGKVEWLGEHPMQARLLNYTSGPAKCHR

SEQ ID NO: 375 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttatttgcgccgattgtgcctgcagtaaaagctgtagagaagagcctgccgaaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 376 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLFAPIVPAVKAVEKSLPKHDRAALVPKVIVANVWQAIDDTMRQSPIIRARVAAGKLKVVGAIYHIDDGKVEWLGEHPMQARLLNYTSGPAKCHR

SEQ ID NO: 377 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggactggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 378 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGVDHLNVPLLVVMGHTQCGAVTAVVQGLEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 379 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtacaggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 380 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVQAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 381 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttatttgcgccgattgtgcctgcagtaacagctgtagagaagagcaacccgaaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 382 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGVDHLNVPLLVVMGHTQCGAVTAVVQGAEVHGSIPMLFAPIVPAVTAVEKSNPKHDRAALVPKVIVANVWQAIDDTMRQSPIIRARVAAGKLKVVGAIYHIDDGKVEWLGEHPMQARLLEYTSGPAKAHR

SEQ ID NO: 383 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggactggaggtacatggatcaatcccgatgttatttgcgccgattgtgcctgcagtacaggctgtagagaagagcaacccgaaacacgaccgcgcggctttagtgccgaaggtgatccatgcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 384 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGADHLNVPLLVVMGHTQCGAVTAVVQGLEVHGSIPMLFAPIVPAVQAVEKSNPKHDRAALVPKVIHANVWQAIDDTMRQSPIIRARVAAGKLKVVGAIYHIDDGKVEWLGEHPMQARLLEYTSGPAKAHR

SEQ ID NO: 385 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 386 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVTAVEKSNPKHDRAALVPKVIVANVWQAIDDTMRQSPIIRARVAAGKLKVVGAIYHIDDGKVEWLGEHPMQARLLEYTSGPAKAHR

SEQ ID NO: 387 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgtctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 388 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 389 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggatgggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 390 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGVDHLNVPLLVVMGHTQCGAVTAVVQGWEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 391 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaaaagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 392 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVKAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 393 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagtggaggtacatggatcaatcccgatgttagtggcgccgattgtgcctgcagtaaaagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 394 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGVEVHGSIPMLVAPIVPAVKAVEKSNPKHDRAALVPKVIEANVWQAIDDTMRQSPIIRARVAAGKLKVVGAIYHIDDGKVEWLGEHPMQARLLEYTSGPAKCHR

SEQ ID NO: 395 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggaaaagaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 396 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGKEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 397 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaaaagctgtagagaagagctttccgaaacacgaccgcgcggctttagtgccgaaggtgatccatgcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 398 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVKAVEKSFPKHDRAALVPKVIHANVWQAIDDTMRQSPIIRARVAAGKLKVVGAIYHIDDGKVEWLGEHPMQARLLNYTSGPAKCHR

SEQ ID NO: 399 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagtggaggtacatggatcaatcccgatgttagtggcgccgattgtgcctgcagtaacagctgtagagaagagctggccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 400 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGVDHLNVPLLVVMGHTQCGAVTAVVQGVEVHGSIPMLVAPIVPAVTAVEKSWPEHDRAALVPKVIEANVWQAIDDTMRQSPIIRARVAAGKLKVVGAIYHIDDGKVEWLGEHPMQARLLEYTSGPAKAHR

SEQ ID NO: 401 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggaaaagaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 402 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGVDHLNVPLLVVMGHTQCGAVTAVVQGKEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 403 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaaaagctgtagagaagagctttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 404 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVKAVEKSFPKHDRAALVPKVIEANVWQAIDDTMRQSPIIRARVAAGKLKVVGAIYHIDDGKVEWLGEHPMQARLLEYTSGPAKAHR

SEQ ID NO: 405 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggatgggaggtacatggatcaatcccgatgttagtggcgccgattgtgcctgcagtaaaagctgtagagaagagctttccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 406 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGVDHLNVPLLVVMGHTQCGAVTAVVQGWEVHGSIPMLVAPIVPAVKAVEKSFPTHDRAALVPKVIEANVWQAIDDTMRQSPIIRARVAAGKLKVVGAIYHIDDGKVEWLGEHPMQARLLNYTSGPAKAHR

SEQ ID NO: 407 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagtggaggtacatggatcaatcccgatgttagtggcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 408 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGVDHLNVPLLVVMGHTQCGAVTAVVQGVEVHGSIPMLVAPIVPAVTAVEKSNPTHDRAALVPKVIEANVWQAIDDTMRQSPIIRARVAAGKLKVVGAIYHIDDGKVEWLGEHPMQARLLEYTSGPAKAHR

SEQ ID NO: 409 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagtggaggtacatggatcaatcccgatgttagtggcgccgattgtgcctgcagtacaggctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 410 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGVEVHGSIPMLVAPIVPAVQAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 411 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagctttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 412 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSFPKHDRAALVPKVIEANVWQAIDDTMRQSPIIRARVAAGKLKVVGAIYHIDDGKVEWLGEHPMQARLLNYTSGPAKAHR

SEQ ID NO: 413 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggatgggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 414 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGWEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 415 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggatgggaggtacatggatcaatcccgatgttagtggcgccgattgtgcctgcagtacaggctgtagagaagagcaacccgaaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 416 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGVDHLNVPLLVVMGHTQCGAVTAVVQGWEVHGSIPMLVAPIVPAVQAVEKSNPKHDRAALVPKVIVANVWQAIDDTMRQSPIIRARVAAGKLKVVGAIYHIDDGKVEWLGEHPMQARLLEYTSGPAKAHR

SEQ ID NO: 417 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 418 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 419 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagctttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 420 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVTAVEKSFPKHDRAALVPKVIEANVWQAIDDTMRQSPIIRARVAAGKLKVVGAIYHIDDGKVEWLGEHPMQARLLNYTSGPAKAHR

SEQ ID NO: 421 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggaaaagaggtacatggatcaatcccgatgttatttgcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 422 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGVDHLNVPLLVVMGHTQCGAVTAVVQGKEVHGSIPMLFAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 423 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttatttgcgccgattgtgcctgcagtaacagctgtagagaagagctttccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 424 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLFAPIVPAVTAVEKSFPEHDRAALVPKVIEANVWQAIDDTMRQSPIIRARVAAGKLKVVGAIYHIDDGKVEWLGEHPMQARLLNYTSGPAKAHR

SEQ ID NO: 425 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaaaagctgtagagaagagctttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 426 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVKAVEKSFPKHDRAALVPKVIEANVWQAIDDTMRQSPIIRARVAAGKLKVVGAIYHIDDGKVEWLGEHPMQARLLNYTSGPAKCHR

SEQ ID NO: 427 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagtggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 428 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGADHLNVPLLVVMGHTQCGAVTAVVQGVEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 429 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtacaggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 430 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVQAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 431 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggatgggaggtacatggatcaatcccgatgttagtggcgccgattgtgcctgcagtacaggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 432 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGADHLNVPLLVVMGHTQCGAVTAVVQGWEVHGSIPMLVAPIVPAVQAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 433 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 434 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 435 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttatttgcgccgattgtgcctgcagtaaaagctgtagagaagagcaacccgacccacgaccgcgcggctttagtgccgaaggtgatccatgcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 436 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGVDHLNVPLLVVMGHTQCGAVTAVVQGAEVHGSIPMLFAPIVPAVKAVEKSNPTHDRAALVPKVIHANVWQAIDDTMRQSPIIRARVAAGKLKVVGAIYHIDDGKVEWLGEHPMQARLLNYTSGPAKAHR

SEQ ID NO: 437 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 438 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLEYTSGPAKCHR

SEQ ID NO: 439 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtacaggctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 440 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVQAVEKSNPTHDRAALVPKVIEANVWQAIDDTMRQSPIIRARVAAGKLKVVGAIYHIDDGKVEWLGEHPMQARLLNYTSGPAKCHR

SEQ ID NO: 441 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaaaagctgtagagaagagcaacccggaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 442 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVKAVEKSNPEHDRAALVPKVIEANVWQAIDDTMRQSPIIRARVAAGKLKVVGAIYHIDDGKVEWLGEHPMQARLLNYTSGPAKAHR

SEQ ID NO: 443 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttatttgcgccgattgtgcctgcagtacaggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 444 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLFAPIVPAVQAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 445 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggatgggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 446 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGVDHLNVPLLVVMGHTQCGAVTAVVQGWEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 447 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggactggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 448 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGVDHLNVPLLVVMGHTQCGAVTAVVQGLEVHGSIPMLVAPIVPAVTAVEKSNPKHDRAALVPKVIEANVWQAIDDTMRQSPIIRARVAAGKLKVVGAIYHIDDGKVEWLGEHPMQARLLEYTSGPAKAHR

SEQ ID NO: 449 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaaaagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 450 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVKAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 451 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagtggaggtacatggatcaatcccgatgttagtggcgccgattgtgcctgcagtaacagctgtagagaagagctttccggaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 452 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGVDHLNVPLLVVMGHTQCGAVTAVVQGVEVHGSIPMLVAPIVPAVTAVEKSFPEHDRAALVPKVIVANVWQAIDDTMRQSPIIRARVAAGKLKVVGAIYHIDDGKVEWLGEHPMQARLLNYTSGPAKAHR

SEQ ID NO: 453 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggactggaggtacatggatcaatcccgatgttagtggcgccgattgtgcctgcagtaacagctgtagagaagagcaacccgaaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 454 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGVDHLNVPLLVVMGHTQCGAVTAVVQGLEVHGSIPMLVAPIVPAVTAVEKSNPKHDRAALVPKVIVANVWQAIDDTMRQSPIIRARVAAGKLKVVGAIYHIDDGKVEWLGEHPMQARLLEYTSGPAKAHR

SEQ ID NO: 455 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggatgggaggtacatggatcaatcccgatgttagtggcgccgattgtgcctgcagtaacagctgtagagaagagctttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 456 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGADHLNVPLLVVMGHTQCGAVTAVVQGWEVHGSIPMLVAPIVPAVTAVEKSFPKHDRAALVPKVIEANVWQAIDDTMRQSPIIRARVAAGKLKVVGAIYHIDDGKVEWLGEHPMQARLLNYTSGPAKCHR

SEQ ID NO: 457 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagctttccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 458 - protein, 223 aa, Artificial Sequence
  Engineered variant of carbonic anhydrase from D. vulgaris
MGSTGPGIGPDEALQRLKEGNARFVAETPTRQNLSAKRLWTSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSFPTHDRAALVPKVIEANVWQAIDDTMRQSPIIRARVAAGKLKVVGAIYHIDDGKVEWLGEHPMQARLLEYTSGPAKAHR

SEQ ID NO: 459 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 460 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVTAVEKSNPKHDRAALVPKVIVANVWQAIDDTMRQSPIIRARVAAGKLKVVGAIYHIDDGKVEWLGEHPMQARLLNYTSGPAKAHR

SEQ ID NO: 461 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggaaaagaggtacatggatcaatcccgatgttagtggcgccgattgtgcctgcagtaacagctgtagagaagagcaacccgaaacacgaccgcgcggctttagtgccgaaggtgatccatgcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 462 - protein, 223 aa, Artificial Sequence
  Engineered variant of carbonic anhydrase from D. vulgaris
MGSTGPGIGPDEALQRLKEGNARFVAETPTPQNLSAKRLATSQHGQTPYATILSCSDSRAPVELIFDEGVGDLFVIRVAGNVAATDEVGTAEYGVDHLNVPLLVVMGHTQCGAVTAVVQGKEVHGSIPMLVAPIVPAVTAVEKSNPKHDRAALVPKVIHANVWQAIDDTMRQSPIIRARVAAGKLKVVGAIYHIDDGKVEWLGEHPMQARLLNYTSGPAKCHR

SEQ ID NO: 463 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctaccccgcagaacttatctgcaaagcgcctgtggacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggaaaagaggtacatggatcaatcccgatgttatttgcgccgattgtgcctgcagtacaggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 464 - protein, 223 aa, Artificial Sequence
  Engineered variant of carbonic anhydrase from D. vulgaris
MGSTGPGIGPDEALQRLKEGNARFVAETPTPQNLSAKRLWTSQHGQTPYATILSCSDSRAPVELIFDEGVGDLFVIRVAGNVAATDEVGTAEYGADHLNVPLLVVMGHTQCGAVTAVVQGKEVHGSIPMLFAPIVPAVQAVEKSNPKHDRAALVPKVIEANVWQAIDDTMRQSPIIRARVAAGKLKVVGAIYHIDDGKVEWLGEHPMQARLLEYTSGPAKAHR

SEQ ID NO: 465 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttatttgcgccgattgtgcctgcagtaacagctgtagagaagagcaacccgacccacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 466 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLFAPIVPAVTAVEKSNPTHDRAALVPKVIEANVWQAIDDTMRQSPIIRARVAAGKLKVVGAIYHIDDGKVEWLGEHPMQARLLNYTSGPAKAHR

SEQ ID NO: 467 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 468 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIVANVWQAIDDTMRQSPIIRARVAAGKLKVVGAIYHIDDGKVEWLGEHPMQARLLEYTSGPAKCHR

SEQ ID NO: 469 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaacgtccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 470 - protein, 223 aa, Artificial Sequence
  Engineered variant of carbonic anhydrase from D. vulgaris
MGSTGPGIGPDEALQRLKEGNARFVAETPTRQNLSAKRLATAQHGQRPYATILSCSDSRAPVELIFDAGVGDLFVIRVAGNVAATDEVGTAEYGVDHLNVPLLVVMGHTQCGAVTAVVQGAEVHGSIPMLVAPIVPALTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 471 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 472 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDAGVGDLFVIRVAGNVAATDEVGTAEYGADFLNVPLLVVMGHTQCGAVTAVVQGAEVHGSIPMLVAPIVPALTAVEKLNPKHDRAALVPKVIEANVWQAIDDTMRQSPIIRARVAAGKLKVVGAIYHIDDGKVEWLGEHPMQARLLNYTSGPAKAHR

SEQ ID NO: 473 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttagcggcaaagcgcctggcgacgtctcaacatggacaaacgccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 474 - protein, 223 aa, Artificial Sequence
  Engineered variant of carbonic anhydrase from D. vulgaris
MGSTGPGIGPDEALQRLKEGNARFVAETPTRQNLAAKRLATSQHGQTPYATILSCSDSRAPVELIFDAGVGDLFVIRVAGNVAATDEVGTAEYGADFLNVPLLVVMGHTQCGAVTAVVQGAEVHGSIPMLVAPIVPAVTAVEKLNPKHDRAALVPKVIEANVWQAIDDTMRQSPIIRARVAAGKLKVVGAIYHIDDGKVEWLGEHPMQARLLNYTSGPTKCHR

SEQ ID NO: 475 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttacgtgcaaagcgcctggcgacgtctcaacatggacaaacgccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 476 - protein, 223 aa, Artificial Sequence
  Engineered variant of carbonic anhydrase from D. vulgaris
MGSTGPGIGPDEALQRLKEGNARFVAETPTRQNLRAKRLATSQHGQTPYATILSCSDSRAPVELIFDAGVGDLFVIRVAGNVAATDEVGTAEYGADHLNVPLLVVMGHTQCGAVTAVVQGAEVHGSIPMLVAPIVPAVTAVEKLNPKHDRAALVPKVIEANVWQAIDDTMRQSPIIRARVAAGKLKVVGAIYHIDDGKVEWLGEHPMQARLLNYTSGPAKAHR

SEQ ID NO: 477 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 478 - protein, 223 aa, Artificial Sequence
  Engineered variant of carbonic anhydrase from D. vulgaris
MGSTGPGIGPDEALQRLKEGNARFVAETPTRQNLSAKRLATAQHGQTPYATILSCSDSRAPVELIFDEGVGDLFVIRVAGNVAATDEVGTAEYGADFLNVPLLVVMGHTQCGAVTAVVQGAEVGGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPTKCHR

SEQ ID NO: 479 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaacgtccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggactttcttaacgttcctctgcttgtagtgatgggccatacacaatgcggtgctgtaactgcagtggtacaaggagcggaggtacgtggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 480 - protein, 223 aa, Artificial Sequence
  Engineered variant of carbonic anhydrase from D. vulgaris
MGSTGPGIGPDEALQRLKEGNARFVAETPTRQNLSAKRLATAQHGQRPYATILSCSDSRAPVELIFDEGVGDLFVIRVAGNVAATDEVGTAEYGVDFLNVPLLVVMGHTQCGAVTAVVQGAEVRGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPTKAHR

SEQ ID NO: 481 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacgtggatcaatcccgatgttagtggcgccgattgtgcctgcagtaacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 482 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVRGSIPMLVAPIVPAVTAVEKLNPKHDRAALVPKVIEANVWQAIDDTMRQSPIIRARVAAGKLKVVGAIYHIDDGKVEWLGEHPMQARLLNYTSGPAKAHR

SEQ ID NO: 483 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaacgtccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 484 - protein, 223 aa, Artificial Sequence
  Engineered variant of carbonic anhydrase from D. vulgaris
MGSTGPGIGPDEALQRLKEGNARFVAETPTRQNLSAKRLATAQHGQRPYATILSCSDSRAPVELIFDEGVGDLFVIRVAGNVAATDEVGTAEYGVDHLNVPLLVVMGHTQCGAVTAVVQGAEVHGSIPMLVAPIVPAVTAVEKSNPKHDRAALVPKAIEANVWQAIDDTMRQSPIIRARVAAGKLKVVGAIYHIDDGKVEWLGEHPMQARLLNYTSGPAKAHR

SEQ ID NO: 485 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaacgtccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 486 - protein, 223 aa, Artificial Sequence
  Engineered variant of carbonic anhydrase from D. vulgaris
MGSTGPGIGPDEALQRLKEGNARFVAETPTRQNLSAKRLATAQHGQRPYATILSCSDSRAPVELIFDAGVGDLFVIRVAGNVAATDEVGTAEYGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 487 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggactttcttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagctgaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 488 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGVDFLNVPLLVVMGHTQCGAVTAVVQGAEVGGSIPMLVAPIVPAVTAVEKLNPKHDRAALVPKAIEANVWQAIDDTMRQSPIIRARVAAGKLKVVGAIYHIDDGKVEWLGEHPMQARLLNYTSGPAKAHR

SEQ ID NO: 489 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaacgtccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 490 - protein, 223 aa, Artificial Sequence
  Engineered variant of carbonic anhydrase from D. vulgaris
MGSTGPGIGPDEALQRLKEGNARFVAETPTRQNLSAKRLATAQHGQRPYATILSCSDSRAPVELIFDAGVGDLFVIRVAGNVAATDEVGTAEYGVDHLNVPLLVVMGHTQCGAVTAVVQGAEVGGSIPMLVAPIVPAVTAVEKSNPKHDRAALVPKAIEANVWQAIDDTMRQSPIIRARVAAGKLKVVGAIYHIDDGKVEWLGEHPMQARLLNYTSGPAKAHR

SEQ ID NO: 491 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaaacgccgtatgccacgatcctttcttgtagtgattcaagagcgccagtagagctgatcttcgacgagggcattggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 492 - protein, 223 aa, Artificial Sequence
  Engineered variant of carbonic anhydrase from D. vulgaris
MGSTGPGIGPDEALQRLKEGNARFVAETPTRQNLSAKRLATAQHGQTPYATILSCSDSRAPVELIFDEGIGDLFVIRVAGNVAATDEVGTAEYGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 493 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 494 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKAIEANVWQAIDDTMRQSPIIRARVAAGKLKVVGAIYHIDDGKVEWLGEHPMQARLLNYTSGPAKAHR

SEQ ID NO: 495 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttacgtgcaaagcgcctggcgacgtctcaacatggacaacgtccgtatgccacgatcctttcttgtagtgattcaagagcgccagtagagctgatcttcgacgcgggcattggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 496 - protein, 223 aa, Artificial Sequence
  Engineered variant of carbonic anhydrase from D. vulgaris
MGSTGPGIGPDEALQRLKEGNARFVAETPTRQNLRAKRLATSQHGQRPYATILSCSDSRAPVELIFDAGIGDLFVIRVAGNVAATDEVGTAEYGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 497 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaacgtccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacgtggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 498 - protein, 223 aa, Artificial Sequence
  Engineered variant of carbonic anhydrase from D. vulgaris
MGSTGPGIGPDEALQRLKEGNARFVAETPTRQNLSAKRLATSQHGQRPYATILSCSDSRAPVELIFDEGVGDLFVIRVAGNVAATDEVGTAEYGVDHLNVPLLVVMGHTQCGAVTAVVQGAEVRGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 499 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagtggactttcttaacgttcctctgcttgtagtgatgggccatacacaatgcggtgctgtaactgcagtggtacaaggagcggaggtacgtggatcaatcccgatgttagtggcgccgattgtgcctgcactgacagctgtagagaagctgaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 500 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDAGVGDLFVIRVAGNVAATDEVGTAEYGVDFLNVPLLVVMGHTQCGAVTAVVQGAEVRGSIPMLVAPIVPALTAVEKLNPKHDRAALVPKAIEANVWQAIDDTMRQSPIIRARVAAGKLKVVGAIYHIDDGKVEWLGEHPMQARLLNYTSGPAKAHR

SEQ ID NO: 501 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaacgtccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 502 - protein, 223 aa, Artificial Sequence
  Engineered variant of carbonic anhydrase from D. vulgaris
MGSTGPGIGPDEALQRLKEGNARFVAETPTRQNLSAKRLATSQHGQRPYATILSCSDSRAPVELIFDAGVGDLFVIRVAGNVAATDEVGTAEYGADFLNVPLLVVMGHTQCGAVTAVVQGAEVHGSIPMLVAPIVPALTAVEKSNPKHDRAALVPKVIEANVWQAIDDTMRQSPIIRARVAAGKLKVVGAIYHIDDGKVEWLGEHPMQARLLNYTSGPTKAHR

SEQ ID NO: 503 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 504 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPALTAVEKLNPKHDRAALVPKVIEANVWQAIDDTMRQSPIIRARVAAGKLKVVGAIYHIDDGKVEWLGEHPMQARLLNYTSGPAKAHR

SEQ ID NO: 505 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttagcggcaaagcgcctggcgacggcgcaacatggacaacgtccgtatgccacgatcctttcttgtagtgattcaagagcgccagtagagctgatcttcgacgcgggcattggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagctgaacccgaaacacgaccgcgcggctttagtgccgaaggtgatcgaggcgaacgtgtggcaagcgatcgatgaaacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 506 - protein, 223 aa, Artificial Sequence
  Engineered variant of carbonic anhydrase from D. vulgaris
MGSTGPGIGPDEALQRLKEGNARFVAETPTRQNLAAKRLATAQHGQRPYATILSCSDSRAPVELIFDAGIGDLFVIRVAGNVAATDEVGTAEYGADFLNVPLLVVMGHTQCGAVTAVVQGAEVHGSIPMLVAPIVPALTAVEKLNPKHDRAALVPKVIEANVWQAIDETMRQSPIIRARVAAGKLKVVGAIYHIDDGKVEWLGEHPMQARLLNYTSGPTKAHR

SEQ ID NO: 507 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaacgtccgtatgccacgatcctttcttgtagtgattcaagagcgccagtagagctgatcttcgacgcgggcattggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacgtggatcaatcccgatgttagtggcgccgattgtgcctgcactgacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 508 - protein, 223 aa, Artificial Sequence
  Engineered variant of carbonic anhydrase from D. vulgaris
MGSTGPGIGPDEALQRLKEGNARFVAETPTRQNLSAKRLATSQHGQRPYATILSCSDSRAPVELIFDAGIGDLFVIRVAGNVAATDEVGTAEYGADHLNVPLLVVMGHTQCGAVTAVVQGAEVRGSIPMLVAPIVPALTAVEKSNPKHDRAALVPKVIEANVWQAIDDTMRQSPIIRARVAAGKLKVVGAIYHIDDGKVEWLGEHPMQARLLNYTSGPTKAHR

SEQ ID NO: 509 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaaacgccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 510 - protein, 223 aa, Artificial Sequence
  Engineered variant of carbonic anhydrase from D. vulgaris
MGSTGPGIGPDEALQRLKEGNARFVAETPTRQNLSAKRLATAQHGQTPYATILSCSDSRAPVELIFDAGVGDLFVIRVAGNVAATDEVGTAEYGADFLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 511 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 512 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDAGVGDLFVIRVAGNVAATDEVGTAEYGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 513 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcattggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttagtggcgccgattgtgcctgcactgacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 514 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGIGDLFVIRVAGNVAATDEVGTAEYGVDHLNVPLLVVMGHTQCGAVTAVVQGAEVGGSIPMLVAPIVPALTAVEKLNPKHDRAALVPKVIEANVWQAIDDTMRQSPIIRARVAAGKLKVVGAIYHIDDGKVEWLGEHPMQARLLNYTSGPAKAHR

SEQ ID NO: 515 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 516 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGVDFLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 517 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttacgtgcaaagcgcctggcgacggcgcaacatggacaaacgccgtatgccacgatcctttcttgtagtgattcaagagcgccagtagagctgatcttcgacgcgggcattggcgatctattcgttatccgtgttgcgggcaatgtagcggcgacagatgaagtgggaacagcggagtacggagtggactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 518 - protein, 223 aa, Artificial Sequence
  Engineered variant of carbonic anhydrase from D. vulgaris
MGSTGPGIGPDEALQRLKEGNARFVAETPTRQNLRAKRLATAQHGQTPYATILSCSDSRAPVELIFDAGIGDLFVIRVAGNVAATDEVGTAEYGVDFLNVPLLVVMGHTQCGAVTAVVQGAEVHGSIPMLVAPIVPAVTAVEKSNPKHDRAALVPKAIEANVWQAIDDTMRQSPIIRARVAAGKLKVVGAIYHIDDGKVEWLGEHPMQARLLNYTSGPAKAHR

SEQ ID NO: 519 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaacgtccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagtggactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgaaacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 520 - protein, 223 aa, Artificial Sequence
  Engineered variant of carbonic anhydrase from D. vulgaris
MGSTGPGIGPDEALQRLKEGNARFVAETPTRQNLSAKRLATSQHGQRPYATILSCSDSRAPVELIFDAGVGDLFVIRVAGNVAATDEVGTAEYGVDFLNVPLLVVMGHTQCGAVTAVVQGAEVHGSIPMLVAPIVPAVTAVEKSNPKHDRAALVPKVIEANVWQAIDETMRQSPIIRARVAAGKLKVVGAIYHIDDGKVEWLGEHPMQARLLNYTSGPTKCHR

SEQ ID NO: 521 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaacgtccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagctgaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 522 - protein, 223 aa, Artificial Sequence
  Engineered variant of carbonic anhydrase from D. vulgaris
MGSTGPGIGPDEALQRLKEGNARFVAETPTRQNLSAKRLATSQHGQRPYATILSCSDSRAPVELIFDEGVGDLFVIRVAGNVAATDEVGTAEYGVDHLNVPLLVVMGHTQCGAVTAVVQGAEVHGSIPMLVAPIVPAVTAVEKLNPKHDRAALVPKAIEANVWQAIDDTMRQSPIIRARVAAGKLKVVGAIYHIDDGKVEWLGEHPMQARLLNYTSGPAKCHR

SEQ ID NO: 523 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacgtggatcaatcccgatgttagtggcgccgattgtgcctgcactgacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 524 - protein, 223 aa, Artificial Sequence
  Engineered variant of carbonic anhydrase from D. vulgaris
MGSTGPGIGPDEALQRLKEGNARFVAETPTRQNLSAKRLATAQHGQTPYATILSCSDSRAPVELIFDEGVGDLFVIRVAGNVAATDEVGTAEYGVDHLNVPLLVVMGHTQCGAVTAVVQGAEVRGSIPMLVAPIVPALTAVEKSNPKHDRAALVPKVIEANVWQAIDDTMRQSPIIRARVAAGKLKVVGAIYHIDDGKVEWLGEHPMQARLLNYTSGPTKAHR

SEQ ID NO: 525 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaacgtccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacgtggatcaatcccgatgttagtggcgccgattgtgcctgcactgacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 526 - protein, 223 aa, Artificial Sequence
  Engineered variant of carbonic anhydrase from D. vulgaris
MGSTGPGIGPDEALQRLKEGNARFVAETPTRQNLSAKRLATSQHGQRPYATILSCSDSRAPVELIFDEGVGDLFVIRVAGNVAATDEVGTAEYGADFLNVPLLVVMGHTQCGAVTAVVQGAEVRGSIPMLVAPIVPALTAVEKLNPKHDRAALVPKVIEANVWQAIDDTMRQSPIIRARVAAGKLKVVGAIYHIDDGKVEWLGEHPMQARLLNYTSGPTKAHR

SEQ ID NO: 527 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaacgtccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 528 - protein, 223 aa, Artificial Sequence
  Engineered variant of carbonic anhydrase from D. vulgaris
MGSTGPGIGPDEALQRLKEGNARFVAETPTRQNLSAKRLATAQHGQRPYATILSCSDSRAPVELIFDAGVGDLFVIRVAGNVAATDEVGTAEYGVDHLNVPLLVVMGHTQCGAVTAVVQGAEVHGSIPMLVAPIVPALTAVEKSNPKHDRAALVPKVIEANVWQAIDDTMRQSPIIRARVAAGKLKVVGAIYHIDDGKVEWLGEHPMQARLLNYTSGPTKAHR

SEQ ID NO: 529 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 530 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPALTAVEKLNPKHDRAALVPKVIEANVWQAIDDTMRQSPIIRARVAAGKLKVVGAIYHIDDGKVEWLGEHPMQARLLNYTSGPAKCHR

SEQ ID NO: 531 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaacgtccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 532 - protein, 223 aa, Artificial Sequence
  Engineered variant of carbonic anhydrase from D. vulgaris
MGSTGPGIGPDEALQRLKEGNARFVAETPTRQNLSAKRLATSQHGQRPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKAIEANVWQAIDDTMRQSPIIRARVAAGKLKVVGAIYHIDDGKVEWLGEHPMQARLLNYTSGPTKAHR

SEQ ID NO: 533 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttagcggcaaagcgcctggcgacgtctcaacatggacaacgtccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtaggcggatcaatcccgatgttagtggcgccgattgtgcctgcactgacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 534 - protein, 223 aa, Artificial Sequence
  Engineered variant of carbonic anhydrase from D. vulgaris
MGSTGPGIGPDEALQRLKEGNARFVAETPTRQNLAAKRLATSQHGQRPYATILSCSDSRAPVELIFDAGVGDLFVIRVAGNVAATDEVGTAEYGADFLNVPLLVVMGHTQCGAVTAVVQGAEVGGSIPMLVAPIVPALTAVEKLNPKHDRAALVPKVIEANVWQAIDDTMRQSPIIRARVAAGKLKVVGAIYHIDDGKVEWLGEHPMQARLLNYTSGPAKAHR

SEQ ID NO: 535 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaacgtccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagctgaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 536 - protein, 223 aa, Artificial Sequence
  Engineered variant of carbonic anhydrase from D. vulgaris
MGSTGPGIGPDEALQRLKEGNARFVAETPTRQNLSAKRLATAQHGQRPYATILSCSDSRAPVELIFDAGVGDLFVIRVAGNVAATDEVGTAEYGADFLNVPLLVVMGHTQCGAVTAVVQGAEVGGSIPMLVAPIVPAVTAVEKLNPKHDRAALVPKAIEANVWQAIDDTMRQSPIIRARVAAGKLKVVGAIYHIDDGKVEWLGEHPMQARLLNYTSGPAKCHR

SEQ ID NO: 537 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaaacgccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 538 - protein, 223 aa, Artificial Sequence
  Engineered variant of carbonic anhydrase from D. vulgaris
MGSTGPGIGPDEALQRLKEGNARFVAETPTRQNLSAKRLATAQHGQTPYATILSCSDSRAPVELIFDAGVGDLFVIRVAGNVAATDEVGTAEYGADHLNVPLLVVMGHTQCGAVTAVVQGAEVGGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPTKAHR

SEQ ID NO: 539 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 540 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDAGVGDLFVIRVAGNVAATDEVGTAEYGVDHLNVPLLVVMGHTQCGAVTAVVQGAEVHGSIPMLVAPIVPALTAVEKSNPKHDRAALVPKVIEANVWQAIDDTMRQSPIIRARVAAGKLKVVGAIYHIDDGKVEWLGEHPMQARLLNYTSGPTKCHR

SEQ ID NO: 541 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttacgtgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacgtggatcaatcccgatgttagtggcgccgattgtgcctgcactgacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 542 - protein, 223 aa, Artificial Sequence
  Engineered variant of carbonic anhydrase from D. vulgaris
MGSTGPGIGPDEALQRLKEGNARFVAETPTRQNLRAKRLATSQHGQTPYATILSCSDSRAPVELIFDEGVGDLFVIRVAGNVAATDEVGTAEYGADHLNVPLLVVMGHTQCGAVTAVVQGAEVRGSIPMLVAPIVPALTAVEKLNPKHDRAALVPKVIEANVWQAIDDTMRQSPIIRARVAAGKLKVVGAIYHIDDGKVEWLGEHPMQARLLNYTSGPTKCHR

SEQ ID NO: 543 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaaacgccgtatgccacgatcctttcttgtagtgattcaagagcgccagtagagctgatcttcgacgcgggcattggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgaaacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 544 - protein, 223 aa, Artificial Sequence
  Engineered variant of carbonic anhydrase from D. vulgaris
MGSTGPGIGPDEALQRLKEGNARFVAETPTRQNLSAKRLATAQHGQTPYATILSCSDSRAPVELIFDAGIGDLFVIRVAGNVAATDEVGTAEYGADFLNVPLLVVMGHTQCGAVTAVVQGAEVHGSIPMLVAPIVPAVTAVEKSNPKHDRAALVPKVIEANVWQAIDETMRQSPIIRARVAAGKLKVVGAIYHIDDGKVEWLGEHPMQARLLNYTSGPAKCHR

SEQ ID NO: 545 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 546 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDAGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 547 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 548 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPALTAVEKSNPKHDRAALVPKVIEANVWQAIDDTMRQSPIIRARVAAGKLKVVGAIYHIDDGKVEWLGEHPMQARLLNYTSGPTKCHR

SEQ ID NO: 549 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaacgtccgtatgccacgatcctttcttgtagtgattcaagagcgccagtagagctgatcttcgacgcgggcattggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacgtggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 550 - protein, 223 aa, Artificial Sequence
  Engineered variant of carbonic anhydrase from D. vulgaris
MGSTGPGIGPDEALQRLKEGNARFVAETPTRQNLSAKRLATSQHGQRPYATILSCSDSRAPVELIFDAGIGDLFVIRVAGNVAATDEVGTAEYGADHLNVPLLVVMGHTQCGAVTAVVQGAEVRGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPTKAHR

SEQ ID NO: 551 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgcgggcattggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacgtggatcaatcccgatgttagtggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 552 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDAGIGDLFVIRVAGNVAATDEVGTAEYGADFLNVPLLVVMGHTQCGAVTAVVQGAEVRGSIPMLVAPIVPAVTAVEKSNPKHDRAALVPKAIEANVWQAIDDTMRQSPIIRARVAAGKLKVVGAIYHIDDGKVEWLGEHPMQARLLNYTSGPAKCHR

SEQ ID NO: 553 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttacgtgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 554 - protein, 223 aa, Artificial Sequence
  Engineered variant of carbonic anhydrase from D. vulgaris
MGSTGPGIGPDEALQRLKEGNARFVAETPTRQNLRAKRLATSQHGQTPYATILSCSDSRAPVELIFDEGVGDLFVIRVAGNVAATDEVGTAEYGVDHLNVPLLVVMGHTQCGAVTAVVQGAEVHGSIPMLVAPIVPAVTAVEKSNPKHDRAALVPKAIEANVWQAIDDTMRQSPIIRARVAAGKLKVVGAIYHIDDGKVEWLGEHPMQARLLNYTSGPAKAHR

SEQ ID NO: 555 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 556 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGADFLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 557 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacggcgcaacatggacaacgtccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 558 - protein, 223 aa, Artificial Sequence
  Engineered variant of carbonic anhydrase from D. vulgaris
MGSTGPGIGPDEALQRLKEGNARFVAETPTRQNLSAKRLATAQHGQRPYATILSCSDSRAPVELIFDAGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 559 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttatctgcaaagcgcctggcgacgtctcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggactttcttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 560 - protein, 223 aa, Artificial Sequence
  Engineered variant of carbonic anhydrase from D. vulgaris
MGSTGPGIGPDEALQRLKEGNARFVAETPTRQNLSAKRLATSQHGQTPYATILSCSDSRAPVELIFDEGVGDLFVIRVAGNVAATDEVGTAEYGVDFLNVPLLVVMGHTQCGAVTAVVQGAEVHGSIPMLVAPIVPALTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 561 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttacgtgcaaagcgcctggcgacgtcgcaacatggacaaacgccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcactgacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 562 - protein, 223 aa, Artificial Sequence
  Engineered variant of carbonic anhydrase from D. vulgaris
MGSTGPGIGPDEALQRLKEGNARFVAETPTRQNLRAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPALTAVEKLNPKHDRAALVPKVIEANVWQAIDDTMRQSPIIRARVAAGKLKVVGAIYHIDDGKVEWLGEHPMQARLLNYTSGPAKCHR

SEQ ID NO: 563 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttacgtgcaaagcgcctggcgacgtctcaacatggacaaacgccgtatgccacgatcctttcttgtagtgattcaagagcgccagtagagctgatcttcgacgcgggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacgtggatcaatcccgatgttagtggcgccgattgtgcctgcagtaacagctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 564 - protein, 223 aa, Artificial Sequence
  Engineered variant of carbonic anhydrase from D. vulgaris
MGSTGPGIGPDEALQRLKEGNARFVAETPTRQNLRAKRLATSQHGQTPYATILSCSDSRAPVELIFDAGVGDLFVIRVAGNVAATDEVGTAEYGADHLNVPLLVVMGHTQCGAVTAVVQGAEVRGSIPMLVAPIVPAVTAVEKLNPKHDRAALVPKVIEANVWQAIDDTMRQSPIIRARVAAGKLKVVGAIYHIDDGKVEWLGEHPMQARLLNYTSGPAKCHR

SEQ ID NO: 565 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctacccgtcagaacttacgtgcaaagcgcctggcgacgtctcaacatggacaacgtccgtatgccacgatcctttcttgtagtgattcaagagcgccagtagagctgatcttcgacgcgggcattggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagctgaacccgaaacacgaccgcgcggctttagtgccgaaggcgatcgaggcgaacgtgtggcaagcgatcgatgaaacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 566 - protein, 223 aa, Artificial Sequence
  Engineered variant of carbonic anhydrase from D. vulgaris
MGSTGPGIGPDEALQRLKEGNARFVAETPTRQNLRAKRLATSQHGQRPYATILSCSDSRAPVELIFDAGIGDLFVIRVAGNVAATDEVGTAEYGADHLNVPLLVVMGHTQCGAVTAVVQGAEVHGSIPMLVAPIVPAVTAVEKLNPKHDRAALVPKAIEANVWQAIDETMRQSPIIRARVAAGKLKVVGAIYHIDDGKVEWLGEHPMQARLLNYTSGPTKCHR

SEQ ID NO: 567 - DNA, 672 bp, Artificial Sequence
  Engineered variant of carbonic anhydrase from D. vulgaris
atgggtagcacgggaccgggaattgggccagacgaagctttacagcgtcttaaggaaggaaatgctagatttgtagccgaaacacctacccgtcagaacttacgtgcaaagcgcctggcgacgtctcaacatggacaacgtccgtatgccacgatcctttcttgtagtgattcaagagcgccagtagagctgatcttcgacgagggcgtaggcgatctattcgttatccgtgttgcgggcaatgtagcggcgacagatgaagtgggaacagcggagtacggagtggactttcttaacgttcctctgcttgtagtgatgggccatacacaatgcggtgctgtaactgcagtggtacaaggagcggaggtacgtggatcaatcccgatgttagtggcgccgattgtgcctgcactgacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 568 - protein, 223 aa, Artificial Sequence
  Engineered variant of carbonic anhydrase from D. vulgaris
MGSTGPGIGPDEALQRLKEGNARFVAETPTRQNLRAKRLATSQHGQRPYATILSCSDSRAPVELIFDEGVGDLFVIRVAGNVAATDEVGTAEYGVDFLNVPLLVVMGHTQCGAVTAVVQGAEVRGSIPMLVAPIVPALTAVEKSNPKHDRAALVPKVIEANVWQAIDDTMRQSPIIRARVAAGKLKVVGAIYHIDDGKVEWLGEHPMQARLLNYTSGPTKCHR

SEQ ID NO: 569 - DNA, 672 bp, Artificial Sequence
  Engineered variant of carbonic anhydrase from D. vulgaris
atgacaagcacgggaccgggaattggaccagacgaagctttacagcgtcttaaggaaggaaatgctagatttgtagccgaaacacctcgtcgtcagaacttatctgcaaagcgcctgctgacgtctatgcatggacaaacgccgtatgccacgatcctttcttgtagtgattcaagagcgccagtagagctgatcttcgacgagggcattggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgctgctaa

SEQ ID NO: 570 - protein, 223 aa, Artificial Sequence
  Engineered variant of carbonic anhydrase from D. vulgaris
MTSTGPGIGPDEALQRLKEGNARFVAETPRRQNLSAKRLLTSMHGQTPYATILSCSDSRAPVELIFDEGIGDLFVIRVAGNVAQTDEVGTAEYGADHLNVPLLVVMGHTQCGAVTAVVQRAEVHGSIPMLVAPIVPAVMAVEKSNPKHDRAALVPKVIEANVWQAIDDTFRQSPIIRARVAAGKLKVVGAIYHIDDGKVEWLGEHPMQARLLNYTSGPAKACC

SEQ ID NO: 571 - DNA, 672 bp, Artificial Sequence
  Engineered variant of carbonic anhydrase from D. vulgaris
atgacaagcacgggaccgggaattggaccagacgaagctttacagcgtcttaaggaaggaaatgctagatttgtagccgaaacacctcgtcgtaaaaacttatctgcaaagcgcctgctgacgtctatgcatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgactttcttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagcttgccgctaa

SEQ ID NO: 572 - protein, 223 aa, Artificial Sequence
  Engineered variant of carbonic anhydrase from D. vulgaris
MTSTGPGIGPDEALQRLKEGNARFVAETPRRKNLSAKRLLTSMHGQTPYATILSCSDSRAPVELIFDEGVGDLFVIRVAGNVAQTDEVGTAEYGADFLNVPLLVVMGHTQCGAVTAVVQRAEVHGSIPMLVAPIVPAVMAVEKSNPKHDRAALVPKVIEANVWQAIDDTMRQSPIIRARVAAGKLKVVGAIYHIDDGKVRWLGEHPMQARLLNYTSGPAKACR

SEQ ID NO: 573 - DNA, 672 bp, Artificial Sequence
  Engineered variant of carbonic anhydrase from D. vulgaris
atgacaagcacgggaccgggaattggaccagacgaagctttacagcgtcttaaggaaggaaatgctagatttgtagccgaaacacctcgtccgcagaacttatctgcaaagcgcctgctgacgtctatgcatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtactgaagagcaacccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 574 - protein, 223 aa, Artificial Sequence
  Engineered variant of carbonic anhydrase from D. vulgaris
MTSTGPGIGPDEALQRLKEGNARFVAETPRPQNLSAKRLLTSMHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVLKSNPKTDRAALVPKVIEANVWQAIDDTFRQSPIIRARVAAGKLKVVGAIYHIDDGKVEWLGEHPMQARLLNYTSGPAKACR

SEQ ID NO: 575 - DNA, 672 bp, Artificial Sequence
  Engineered variant of carbonic anhydrase from D. vulgaris
atgacaagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcattggcgatctattcgttatccgtgttgcgggcaatgtagcgcagacagatgaagtgggaacagcggagtacggagccgactttcttaacgttcctctgcttgtagtgatgggccatacacaatgcggtgctgtaactgcagtggtacaacgtgcggaggtacatggatcaatcccgatgttagtggcgccgattgtgcctgcagtaatggctgtactgaagagcaacccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagcttgctgctaa

SEQ ID NO: 576 - protein, 223 aa, Artificial Sequence
  Engineered variant of carbonic anhydrase from D. vulgaris
MTSTGPGIGPDEALQRLKEGNARFVAETPRRQNLSAKRLLTSQHGQTPYATILSCSDSRAPVELIFDEGIGDLFVIRVAGNVAQTDEVGTAEYGADFLNVPLLVVMGHTQCGAVTAVVQRAEVHGSIPMLVAPIVPAVMAVLKSNPKTDRAALVPKVIEANVWQAIDDTMRQSPIIRARVAAGKLKVVGAIYHIDDGKVRWLGEHPMQARLLNYTSGPAKACC

SEQ ID NO: 577 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcgtaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtactgaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagcttgccgctaa

SEQ ID NO: 578 - protein, 223 aa, Artificial Sequence
  Engineered variant of carbonic anhydrase from D. vulgaris
MGSTGPGIGPDEALQRLKEGNARFVAETPRPRNLSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVLKSNPKHDRAALVPKVIEANVWQAIDDTMRQSPIIRARVAAGKLKVVGAIYHIDDGKVRWLGEHPMQARLLNYTSGPAKACR

SEQ ID NO: 579 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctatgcatggacaaacgccgtatgccacgatcctttcttgtagtgattcaagagcgccagtagagctgatcttcgacgagggcattggcgatctattcgttatccgtgttgcgggcaatgtagcgcagacagatgaagtgggaacagcggagtacggagccgaacaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 580 - protein, 223 aa, Artificial Sequence
  Engineered variant of carbonic anhydrase from D. vulgaris
MGSTGPGIGPDEALQRLKEGNARFVAETPRRQNLSAKRLLTSMHGQTPYATILSCSDSRAPVELIFDEGIGDLFVIRVAGNVAQTDEVGTAEYGAEHLNVPLLVVMGHTQCGAVTAVVQRAEVHGSIPMLVAPIVPAVMAVEKSNPKHDRAALVPKVIEANVWQAIDDTFRQSPIIRARVAAGKLKVVGAIYHIDDGKVEWLGEHPMQARLLNYTSGPAKACR

SEQ ID NO: 581 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacggcgcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgcgtgcggaggtatttggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 582 - protein, 223 aa, Artificial Sequence
  Engineered variant of carbonic anhydrase from D. vulgaris
MGSTGPGIGPDEALQRLKEGNARFVAETPRPQNLSARRLLTAQHGQTPYATILSCSDSRCPVELIFDAGVGDLFVIRVAGNVAQTDEVGTAEYGADHLNVPLLVVMGHTQCGAVTAVVMRAEVFGSIPMLVAPIVPAVMAVEKSNPKHDRAALVPKVIEANVWQAIDDTMRQSPIIRARVAAGKLKVVGAIYHIDDGKVEWLGEHPMQARLLEYTSGPTKAHR

SEQ ID NO: 583 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtaaaaacttatctgcaaagcgcctgctgacgtctcaacatggacaaacgccgtatgccacgatcctttcttgtagtgattcaagagcgccagtagagctgatcttcgacgagggcattggcgatctattcgttatccgtgttgcgggcaatgtagcgcagacagatgaagtgggaacagcggagtacggagccgaacaccttaacgttcctctgcttgtagtgatgggccatacacaatgcggtgctgtaactgcagtggtacaacgtctggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagctcaccgctaa

SEQ ID NO: 584 - protein, 223 aa, Artificial Sequence
  Engineered variant of carbonic anhydrase from D. vulgaris
MGSTGPGIGPDEALQRLKEGNARFVAETPRRKNLSAKRLLTSQHGQTPYATILSCSDSRAPVELIFDEGIGDLFVIRVAGNVAQTDEVGTAEYGAEHLNVPLLVVMGHTQCGAVTAVVQRLEVHGSIPMLVAPIVPAVMAVEKSNPKHDRAALVPKVIEANVWQAIDDTMRQSPIIRARVAAGKLKVVGAIYHIDDGKVRWLGEHPMQARLLNYTSGPAKAHR

SEQ ID NO: 585 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtctggaggtacatggatcaatcccgatgttagtggcgccgattgtgcctgcagtaatggctgtagagaagagcaacccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagctcactgctaa

SEQ ID NO: 586 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRAPVELIFDEGVGDLFVIRVAGNVAQTDEVGTAEYGADHLNVPLLVVMGHTQCGAVTAVVQRLEVHGSIPMLVAPIVPAVMAVEKSNPKTDRAALVPKVIEANVWQAIDDTMRQSPIIRARVAAGKLKVVGAIYHIDDGKVRWLGEHPMQARLLNYTSGPAKAHC

SEQ ID NO: 587 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 588 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDAGVGDLFVIRVAGNVAQTDEVGTAEYGADHLNVPLLVVMGHTQCGAVTAVVQRAEVHGSIPMLVAPIVPAVMAVEKSWPKHDRAALVPKVIEANVWQAIDDTMRQSPIIRARVAAGKLKVVGAIYHIDDGKVEWLGEHPMQARLLEYTSGPAKAHR

SEQ ID NO: 589 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtactgaagagcaacccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 590 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVLKSNPKTDRAALVPKVIEANVWQAIDDTFRQSPIIRARVAAGKLKVVGAIYHIDDGKVEWLGEHPMQARLLNYTSGPAKACR

SEQ ID NO: 591 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcattggcgatctattcgttatccgtgttgcgggcaatgtagcgcagacagatgaagtgggaacagcggagtacggagccgactttcttaacgttcctctgcttgtagtgatgggccatacacaatgcggtgctgtaactgcagtggtacaacgtctggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagctcaccgctaa

SEQ ID NO: 592 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGIGDLFVIRVAGNVAQTDEVGTAEYGADFLNVPLLVVMGHTQCGAVTAVVQRLEVHGSIPMLVAPIVPAVMAVEKSNPKHDRAALVPKVIEANVWQAIDDTFRQSPIIRARVAAGKLKVVGAIYHIDDGKVRWLGEHPMQARLLNYTSGPAKAHR

SEQ ID NO: 593 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaacaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtactgaagagcaacccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 594 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGVGDLFVIRVAGNVAQTDEVGTAEYGAEHLNVPLLVVMGHTQCGAVTAVVQRAEVHGSIPMLVAPIVPAVMAVLKSNPKHDRAALVPKVIEANVWQAIDDTFRQSPIIRARVAAGKLKVVGAIYHIDDGKVEWLGEHPMQARLLNYTSGPAKAHC

SEQ ID NO: 595 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgcgtttcttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 596 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGVGDLFVIRVAGNVAQTDEVGTAEYGAAFLNVPLLVVMGHTQCGAVTAVVQRAEVHGSIPMLVAPIVPAVMAVEKSNPKTDRAALVPKVIEANVWQAIDDTFRQSPIIRARVAAGKLKVVGAIYHIDDGKVEWLGEHPMQARLLNYTSGPAKACR

SEQ ID NO: 597 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacggcgcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagctgtggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 598 - protein, 223 aa, Artificial Sequence
  Engineered variant of carbonic anhydrase from D. vulgaris
MGSTGPGIGPDEALQRLKEGNARFVAETPRRQNLSARRLLTAQHGQTPYATILSCSDSRAPVELIFDAGVGDLFVIRVAGNVAQTDEVGTAEYGADHLNVPLLVVMGHTQCGAVTAVVQRAEVHGSIPMLVAPIVPAVMAVEKLWPKHDRAALVPKVIEANVWQAIDDTMRQSPIIRARVAAGKLKVVGAIYHIDDGKVEWLGEHPMQARLLNYTSGPTKCHR

SEQ ID NO: 599 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 600 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVEKSNPKTDRAALVPKVIEANVWQAIDDTFRQSPIIRARVAAGKLKVVGAIYHIDDGKVEWLGEHPMQARLLNYTSGPAKAHR

SEQ ID NO: 601 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgactttcttaacgttcctctgcttgtagtgatgggccatacacaatgcggtgctgtaactgcagtggtacaacgtctggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagctcaccgctaa

SEQ ID NO: 602 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGVGDLFVIRVAGNVAQTDEVGTAEYGADFLNVPLLVVMGHTQCGAVTAVVQRLEVHGSIPMLVAPIVPAVMAVEKSNPKHDRAALVPKVIEANVWQAIDDTFRQSPIIRARVAAGKLKVVGAIYHIDDGKVRWLGEHPMQARLLNYTSGPAKAHR

SEQ ID NO: 603 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagatgcccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 604 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRCPVELIFDEGVGDLFVIRVAGNVAQTDEVGTAEYGVDHLNVPLLVVMGHTQCGAVTAVVQRAEVHGSIPMLVAPIVPAVMAVEKSWPKHDRAALVPKVIEANVWQAIDDTMRQSPIIRARVAAGKLKVVGAIYHIDDGKVEWLGEHPMQARLLNYTSGPTKCHR

SEQ ID NO: 605 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcgtaacttatctgcaaagcgcctgctgacgtctatgcatggacaaacgccgtatgccacgatcctttcttgtagtgattcaagagcgccagtagagctgatcttcgacgagggcattggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtctggaggtacatggatcaatcccgatgttagtggcgccgattgtgcctgcagtaatggctgtagagaagagcaacccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 606 - protein, 223 aa, Artificial Sequence
  Engineered variant of carbonic anhydrase from D. vulgaris
MGSTGPGIGPDEALQRLKEGNARFVAETPRRRNLSAKRLLTSMHGQTPYATILSCSDSRAPVELIFDEGIGDLFVIRVAGNVAQTDEVGTAEYGADHLNVPLLVVMGHTQCGAVTAVVQRLEVHGSIPMLVAPIVPAVMAVEKSNPKTDRAALVPKVIEANVWQAIDDTMRQSPIIRARVAAGKLKVVGAIYHIDDGKVEWLGEHPMQARLLNYTSGPAKACR

SEQ ID NO: 607 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 608 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRCPVELIFDAGVGDLFVIRVAGNVAQTDEVGTAEYGVDHLNVPLLVVMGHTQCGAVTAVVMRAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPTKAHR

SEQ ID NO: 609 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacggcgcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacgtggatcaatcccgatgttagtggcgccgattgtgcctgcagtaatggctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 610 - protein, 223 aa, Artificial Sequence
  Engineered variant of carbonic anhydrase from D. vulgaris
MGSTGPGIGPDEALQRLKEGNARFVAETPRPQNLSAKRLLTAQHGQTPYATILSCSDSRAPVELIFDEGVGDLFVIRVAGNVAQTDEVGTAEYGADHLNVPLLVVMGHTQCGAVTAVVQRAEVRGSIPMLVAPIVPAVMAVEKLNPKHDRAALVPKVIEANVWQAIDDTMRQSPIIRARVAAGKLKVVGAIYHIDDGKVEWLGEHPMQARLLNYTSGPAKAHR

SEQ ID NO: 611 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacggcgcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtatttggatcaatcccgatgttagtggcgccgattgtgcctgcagtaatggctgtagagaagctgtttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 612 - protein, 223 aa, Artificial Sequence
  Engineered variant of carbonic anhydrase from D. vulgaris
MGSTGPGIGPDEALQRLKEGNARFVAETPRPQNLSAKRLLTAQHGQTPYATILSCSDSRAPVELIFDAGVGDLFVIRVAGNVAQTDEVGTAEYGADHLNVPLLVVMGHTQCGAVTAVVQRAEVFGSIPMLVAPIVPAVMAVEKLFPKHDRAALVPKVIEANVWQAIDDTMRQSPIIRARVAAGKLKVVGAIYHIDDGKVEWLGEHPMQARLLNYTSGPAKCHR

SEQ ID NO: 613 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagatgcccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 614 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRCPVELIFDEGVGDLFVIRVAGNVAQTDEVGTAEYGADHLNVPLLVVMGHTQCGAVTAVVMRAEVHGSIPMLVAPIVPAVMAVEKLNPKHDRAALVPKVIEANVWQAIDDTMRQSPIIRARVAAGKLKVVGAIYHIDDGKVEWLGEHPMQARLLNYTSGPTKCHR

SEQ ID NO: 615 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacggcgcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 616 - protein, 223 aa, Artificial Sequence
  Engineered variant of carbonic anhydrase from D. vulgaris
MGSTGPGIGPDEALQRLKEGNARFVAETPRRQNLSAKRLLTAQHGQTPYATILSCSDSRCPVELIFDAGVGDLFVIRVAGNVAQTDEVGTAEYGADHLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVEWLGEHPMQARLLNYTSGPAKAHR

SEQ ID NO: 617 - DNA, 672 bp, Artificial Sequence
  Engineered variant of carbonic anhydrase from D. vulgaris
atgacaagcacgggaccgggaattggaccagacgaagctttacagcgtcttaaggaaggaaatgctagatttgtagccgaaacacctcgtccgaaaaacttatctgcaaagcgcctgctgacgtctatgcatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 618 - protein, 223 aa, Artificial Sequence
  Engineered variant of carbonic anhydrase from D. vulgaris
MTSTGPGIGPDEALQRLKEGNARFVAETPRPKNLSAKRLLTSMHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 619 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacgtggatcaatcccgatgttagtggcgccgattgtgcctgcagtaatggctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 620 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRAPVELIFDAGVGDLFVIRVAGNVAQTDEVGTAEYGADHLNVPLLVVMGHTQCGAVTAVVQRAEVRGSIPMLVAPIVPAVMAVEKSNPKHDRAALVPKAIEANVWQAIDDTMRQSPIIRARVAAGKLKVVGAIYHIDDGKVEWLGEHPMQARLLNYTSGPAKAHR

SEQ ID NO: 621 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 622 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRAPVELIFDEGVGDLFVIRVAGNVAQTDEVGTAEYGADHLNVPLLVVMGHTQCGAVTAVVMRAEVHGSIPMLVAPIVPAVMAVEKLNPKHDRAALVPKAIEANVWQAIDDTMRQSPIIRARVAAGKLKVVGAIYHIDDGKVEWLGEHPMQARLLEYTSGPAKAHR

SEQ ID NO: 623 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtaaaaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtactgaagagcaacccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagctcactgctaa

SEQ ID NO: 624 - protein, 223 aa, Artificial Sequence
  Engineered variant of carbonic anhydrase from D. vulgaris
MGSTGPGIGPDEALQRLKEGNARFVAETPRRKNLSAKRLLTSQHGQTPYATILSCSDSRAPVELIFDEGVGDLFVIRVAGNVAQTDEVGTAEYGADHLNVPLLVVMGHTQCGAVTAVVQRAEVHGSIPMLVAPIVPAVMAVLKSNPKTDRAALVPKVIEANVWQAIDDTFRQSPIIRARVAAGKLKVVGAIYHIDDGKVRWLGEHPMQARLLNYTSGPAKAHC

SEQ ID NO: 625 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgaaaaacttatctacaaagcgcctgctgacgtctcaacatggacaaacgccgtatgccacgatcctttcttgtagtgattcaagagcgccagtagagctgatcttcgacgagggcattggcgatctattcgttatccgtgttgcgggcaatgtagcgcagacagatgaagtgggaacagcggagtacggagccgaacaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtactgaagagcaacccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 626 - protein, 223 aa, Artificial Sequence
  Engineered variant of carbonic anhydrase from D. vulgaris
MGSTGPGIGPDEALQRLKEGNARFVAETPRPKNLSTKRLLTSQHGQTPYATILSCSDSRAPVELIFDEGIGDLFVIRVAGNVAQTDEVGTAEYGAEHLNVPLLVVMGHTQCGAVTAVVQRAEVHGSIPMLVAPIVPAVMAVLKSNPKTDRAALVPKVIEANVWQAIDDTMRQSPIIRARVAAGKLKVVGAIYHIDDGKVEWLGEHPMQARLLNYTSGPAKAHR

SEQ ID NO: 627 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagatgcccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 628 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRCPVELIFDEGVGDLFVIRVAGNVAQTDEVGTAEYGVDHLNVPLLVVMGHTQCGAVTAVVMRAEVHGSIPMLVAPIVPAVMAVEKSNPKHDRAALVPKAIEANVWQAIDDTMRQSPIIRARVAAGKLKVVGAIYHIDDGKVEWLGEHPMQARLLEYTSGPTKAHR

SEQ ID NO: 629 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagctgtggccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 630 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRAPVELIFDAGVGDLFVIRVAGNVAQTDEVGTAEYGADHLNVPLLVVMGHTQCGAVTAVVQRAEVHGSIPMLVAPIVPAVMAVEKLWPKHDRAALVPKAIEANVWQAIDDTMRQSPIIRARVAAGKLKVVGAIYHIDDGKVEWLGEHPMQARLLEYTSGPAKAHR

SEQ ID NO: 631 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagatgcccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 632 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRCPVELIFDEGVGDLFVIRVAGNVAQTDEVGTAEYGADHLNVPLLVVMGHTQCGAVTAVVMRAEVRGSIPMLVAPIVPAVMAVEKLWPKHDRAALVPKVIEANVWQAIDDTMRQSPIIRARVAAGKLKVVGAIYHIDDGKVEWLGEHPMQARLLEYTSGPAKCHR

SEQ ID NO: 633 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtggccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 634 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGVGDLFVIRVAGNVAQTDEVGTAEYGVDHLNVPLLVVMGHTQCGAVTAVVMRAEVRGSIPMLVAPIVPAVMAVEKLWPKHDRAALVPKAIEANVWQAIDDTMRQSPIIRARVAAGKLKVVGAIYHIDDGKVEWLGEHPMQARLLNYTSGPAKCHR

SEQ ID NO: 635 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacggcgcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgtttccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 636 - protein, 223 aa, Artificial Sequence
  Engineered variant of carbonic anhydrase from D. vulgaris
MGSTGPGIGPDEALQRLKEGNARFVAETPRRQNLSARRLLTAQHGQTPYATILSCSDSRCPVELIFDAGVGDLFVIRVAGNVAQTDEVGTAEYGADHLNVPLLVVMGHTQCGAVTAVVMRAEVHGSIPMLVAPIVPAVMAVEKLFPKHDRAALVPKAIEANVWQAIDDTMRQSPIIRARVAAGKLKVVGAIYHIDDGKVEWLGEHPMQARLLNYTSGPAKCHR

SEQ ID NO: 637 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacggcgcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 638 - protein, 223 aa, Artificial Sequence
  Engineered variant of carbonic anhydrase from D. vulgaris
MGSTGPGIGPDEALQRLKEGNARFVAETPRPQNLSAKRLLTAQHGQTPYATILSCSDSRAPVELIFDEGVGDLFVIRVAGNVAQTDEVGTAEYGVDHLNVPLLVVMGHTQCGAVTAVVMRAEVRGSIPMLVAPIVPAVMAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 639 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaacgtgcggaggtatttggatcaatcccgatgttagtggcgccgattgtgcctgcagtaatggctgtagagaagctgtttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 640 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRCPVELIFDAGVGDLFVIRVAGNVAQTDEVGTAEYGVDHLNVPLLVVMGHTQCGAVTAVVQRAEVFGSIPMLVAPIVPAVMAVEKLFPKHDRAALVPKVIEANVWQAIDDTMRQSPIIRARVAAGKLKVVGAIYHIDDGKVEWLGEHPMQARLLEYTSGPTKAHR

SEQ ID NO: 641 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacggcgcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 642 - protein, 223 aa, Artificial Sequence
  Engineered variant of carbonic anhydrase from D. vulgaris
MGSTGPGIGPDEALQRLKEGNARFVAETPRRQNLSAKRLLTAQHGQTPYATILSCSDSRAPVELIFDEGVGDLFVIRVAGNVAQTDEVGTAEYGVDHLNVPLLVVMGHTQCGAVTAVVMRAEVRGSIPMLVAPIVPAVMAVEKLNPKHDRAALVPKVIEANVWQAIDDTMRQSPIIRARVAAGKLKVVGAIYHIDDGKVEWLGEHPMQARLLNYTSGPAKCHR

SEQ ID NO: 643 - DNA, 672 bp, Artificial Sequence
  Engineered variant of carbonic anhydrase from D. vulgaris
atgacaagcacgggaccgggaattggaccagacgaagctttacagcgtcttaaggaaggaaatgctagatttgtagccgaaacacctcgtccgaaaaacttatctgcaaagcgcctgctgacgtctatgcatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgcgtttcttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagcttgccgctaa

SEQ ID NO: 644 - protein, 223 aa, Artificial Sequence
  Engineered variant of carbonic anhydrase from D. vulgaris
MTSTGPGIGPDEALQRLKEGNARFVAETPRPKNLSAKRLLTSMHGQTPYATILSCSDSRAPVELIFDEGVGDLFVIRVAGNVAQTDEVGTAEYGAAFLNVPLLVVMGHTQCGAVTAVVQRAEVHGSIPMLVAPIVPAVMAVEKSNPKHDRAALVPKVIEANVWQAIDDTFRQSPIIRARVAAGKLKVVGAIYHIDDGKVRWLGEHPMQARLLNYTSGPAKACR

SEQ ID NO: 645 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgtttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 646 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRAPVELIFDAGVGDLFVIRVAGNVAQTDEVGTAEYGVDHLNVPLLVVMGHTQCGAVTAVVMRAEVHGSIPMLVAPIVPAVMAVEKLFPKHDRAALVPKVIEANVWQAIDDTMRQSPIIRARVAAGKLKVVGAIYHIDDGKVEWLGEHPMQARLLNYTSGPAKAHR

SEQ ID NO: 647 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctatgcatggacaaacgccgtatgccacgatcctttcttgtagtgattcaagagcgccagtagagctgatcttcgacgagggcattggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtctggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 648 - protein, 223 aa, Artificial Sequence
  Engineered variant of carbonic anhydrase from D. vulgaris
MGSTGPGIGPDEALQRLKEGNARFVAETPRRQNLSAKRLLTSMHGQTPYATILSCSDSRAPVELIFDEGIGDLFVIRVAGNVAQTDEVGTAEYGADHLNVPLLVVMGHTQCGAVTAVVQRLEVHGSIPMLVAPIVPAVMAVEKSNPKHDRAALVPKVIEANVWQAIDDTFRQSPIIRARVAAGKLKVVGAIYHIDDGKVEWLGEHPMQARLLNYTSGPAKAHC

SEQ ID NO: 649 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtatttggatcaatcccgatgttagtggcgccgattgtgcctgcagtaatggctgtagagaagctgaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 650 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDAGVGDLFVIRVAGNVAQTDEVGTAEYGVDHLNVPLLVVMGHTQCGAVTAVVMRAEVFGSIPMLVAPIVPAVMAVEKLNPKHDRAALVPKAIEANVWQAIDDTMRQSPIIRARVAAGKLKVVGAIYHIDDGKVEWLGEHPMQARLLEYTSGPAKCHR

SEQ ID NO: 651 - DNA, 672 bp, Artificial Sequence
  Engineered variant of carbonic anhydrase from D. vulgaris
atgacaagcacgggaccgggaattggaccagacgaagctttacagcgtcttaaggaaggaaatgctagatttgtagccgaaacacctcgtccgcagaacttatctgcaaagcgcctgctgacgtctatgcatggacaaacgccgtatgccacgatcctttcttgtagtgattcaagagcgccagtagagctgatcttcgacgagggcattggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtactgaagagcaacccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagcttgccgctaa

SEQ ID NO: 652 - protein, 223 aa, Artificial Sequence
  Engineered variant of carbonic anhydrase from D. vulgaris
MTSTGPGIGPDEALQRLKEGNARFVAETPRPQNLSAKRLLTSMHGQTPYATILSCSDSRAPVELIFDEGIGDLFVIRVAGNVAQTDEVGTAEYGADHLNVPLLVVMGHTQCGAVTAVVQRAEVHGSIPMLVAPIVPAVMAVLKSNPKTDRAALVPKVIEANVWQAIDDTFRQSPIIRARVAAGKLKVVGAIYHIDDGKVRWLGEHPMQARLLNYTSGPAKACR

SEQ ID NO: 653 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaatgccaccgctaa

SEQ ID NO: 654 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRCPVELIFDAGVGDLFVIRVAGNVAQTDEVGTAEYGVDHLNVPLLVVMGHTQCGAVTAVVMRAEVRGSIPMLVAPIVPAVMAVEKSNPKHDRAALVPKVIEANVWQAIDDTMRQSPIIRARVAAGKLKVVGAIYHIDDGKVEWLGEHPMQARLLEYTSGPTKCHR

SEQ ID NO: 655 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 656 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRAPVELIFDAGVGDLFVIRVAGNVAQTDEVGTAEYGVDHLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVEWLGEHPMQARLLEYTSGPTKAHR

SEQ ID NO: 657 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaacgtgcggaggtacgtggatcaatcccgatgttagtggcgccgattgtgcctgcagtaatggctgtagagaagctgtttccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 658 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRAPVELIFDEGVGDLFVIRVAGNVAQTDEVGTAEYGADHLNVPLLVVMGHTQCGAVTAVVQRAEVRGSIPMLVAPIVPAVMAVEKLFPKHDRAALVPKAIEANVWQAIDDTMRQSPIIRARVAAGKLKVVGAIYHIDDGKVEWLGEHPMQARLLNYTSGPTKCHR

SEQ ID NO: 659 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacggcgcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 660 - protein, 223 aa, Artificial Sequence
  Engineered variant of carbonic anhydrase from D. vulgaris
MGSTGPGIGPDEALQRLKEGNARFVAETPRRQNLSARRLLTAQHGQTPYATILSCSDSRAPVELIFDEGVGDLFVIRVAGNVAQTDEVGTAEYGVDHLNVPLLVVMGHTQCGAVTAVVMRAEVRGSIPMLVAPIVPAVMAVEKLNPKHDRAALVPKAIEANVWQAIDDTMRQSPIIRARVAAGKLKVVGAIYHIDDGKVEWLGEHPMQARLLEYTSGPAKCHR

SEQ ID NO: 661 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagctgtttccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 662 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGVGDLFVIRVAGNVAQTDEVGTAEYGVDHLNVPLLVVMGHTQCGAVTAVVQRAEVHGSIPMLVAPIVPAVMAVEKLFPKHDRAALVPKAIEANVWQAIDDTMRQSPIIRARVAAGKLKVVGAIYHIDDGKVEWLGEHPMQARLLNYTSGPAKCHR

SEQ ID NO: 663 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaacgtgcggaggtacgtggatcaatcccgatgttagtggcgccgattgtgcctgcagtaatggctgtagagaagctgtttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaatgccaccgctaa

SEQ ID NO: 664 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRAPVELIFDEGVGDLFVIRVAGNVAQTDEVGTAEYGVDHLNVPLLVVMGHTQCGAVTAVVQRAEVRGSIPMLVAPIVPAVMAVEKLFPKHDRAALVPKVIEANVWQAIDDTMRQSPIIRARVAAGKLKVVGAIYHIDDGKVEWLGEHPMQARLLNYTSGPTKCHR

SEQ ID NO: 665 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagatgcccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 666 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRCPVELIFDEGVGDLFVIRVAGNVAQTDEVGTAEYGVDHLNVPLLVVMGHTQCGAVTAVVMRAEVHGSIPMLVAPIVPAVMAVEKLNPKHDRAALVPKAIEANVWQAIDDTMRQSPIIRARVAAGKLKVVGAIYHIDDGKVEWLGEHPMQARLLNYTSGPTKAHR

SEQ ID NO: 667 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacggcgcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaatgccaccgctaa

SEQ ID NO: 668 - protein, 223 aa, Artificial Sequence
  Engineered variant of carbonic anhydrase from D. vulgaris
MGSTGPGIGPDEALQRLKEGNARFVAETPRPQNLSARRLLTAQHGQTPYATILSCSDSRCPVELIFDAGVGDLFVIRVAGNVAQTDEVGTAEYGVDHLNVPLLVVMGHTQCGAVTAVVMRAEVRGSIPMLVAPIVPAVMAVEKLWPKHDRAALVPKVIEANVWQAIDDTMRQSPIIRARVAAGKLKVVGAIYHIDDGKVEWLGEHPMQARLLEYTSGPTKCHR

SEQ ID NO: 669 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcaaagcgcctgctgacgtctcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtttccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgccaaagctcaccgctaa

SEQ ID NO: 670 - protein, 223 aa, Artificial Sequence
  Engineered variant of carbonic anhydrase from D. vulgaris
MGSTGPGIGPDEALQRLKEGNARFVAETPRRQNLSAKRLLTSQHGQTPYATILSCSDSRCPVELIFDAGVGDLFVIRVAGNVAQTDEVGTAEYGADHLNVPLLVVMGHTQCGAVTAVVMRAEVRGSIPMLVAPIVPAVMAVEKLFPKHDRAALVPKAIEANVWQAIDDTMRQSPIIRARVAAGKLKVVGAIYHIDDGKVEWLGEHPMQARLLNYTSGPAKAHR

SEQ ID NO: 671 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacgtctcaacatggacaaacgccgtatgccacgatcctttcttgtagtgattcaagatgcccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 672 - protein, 223 aa, Artificial Sequence
  Engineered variant of carbonic anhydrase from D. vulgaris
MGSTGPGIGPDEALQRLKEGNARFVAETPRPQNLSAKRLLTSQHGQTPYATILSCSDSRCPVELIFDEGVGDLFVIRVAGNVAQTDEVGTAEYGVDHLNVPLLVVMGHTQCGAVTAVVMRAEVRGSIPMLVAPIVPAVMAVEKSNPKHDRAALVPKAIEANVWQAIDDTMRQSPIIRARVAAGKLKVVGAIYHIDDGKVEWLGEHPMQARLLNYTSGPAKCHR

SEQ ID NO: 673 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagctgtttccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 674 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVDHLNVPLLVVMGHTQCGAVTAVVQRAEVHGSIPMLVAPIVPAVMAVEKLFPKHDRAALVPKAIEANVWQAIDDTMRQSPIIRARVAAGKLKVVGAIYHIDDGKVEWLGEHPMQARLLEYTSGPAKCHR

SEQ ID NO: 675 - DNA, 672 bp, Artificial Sequence
  Engineered variant of carbonic anhydrase from D. vulgaris
atgacaagcacgggaccgggaattggaccagacgaagctttacagcgtcttaaggaaggaaatgctagatttgtagccgaaacacctcgtccgcagaacttatctgcaaagcgcctgctgacgtctatgcatggacaaacgccgtatgccacgatcctttcttgtagtgattcaagagcgccagtagagctgatcttcgacgagggcgtaggcgatctattcgttatccgtgttgcgggcaatgtagcgcagacagatgaagtgggaacagcggagtacggagccgactttcttaacgttcctctgcttgtagtgatgggccatacacaatgcggtgctgtaactgcagtggtacaacgtgcggaggtacatggatcaatcccgatgttagtggcgccgattgtgcctgcagtaatggctgtagagaagagcaacccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagctcaccgctaa

SEQ ID NO: 676 - protein, 223 aa, Artificial Sequence
  Engineered variant of carbonic anhydrase from D. vulgaris
MTSTGPGIGPDEALQRLKEGNARFVAETPRPQNLSAKRLLTSMHGQTPYATILSCSDSRAPVELIFDEGVGDLFVIRVAGNVAQTDEVGTAEYGADFLNVPLLVVMGHTQCGAVTAVVQRAEVHGSIPMLVAPIVPAVMAVEKSNPKHDRAALVPKVIEANVWQAIDDTFRQSPIIRARVAAGKLKVVGAIYHIDDGKVRWLGEHPMQARLLNYTSGPAKAHR

SEQ ID NO: 677 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcaaagcgcctgctgacggcgcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 678 - protein, 223 aa, Artificial Sequence
  Engineered variant of carbonic anhydrase from D. vulgaris
MGSTGPGIGPDEALQRLKEGNARFVAETPRPQNLSAKRLLTAQHGQTPYATILSCSDSRCPVELIFDAGVGDLFVIRVAGNVAQTDEVGTAEYGVDHLNVPLLVVMGHTQCGAVTAVVMRAEVHGSIPMLVAPIVPAVMAVEKSFPKHDRAALVPKVIEANVWQAIDDTMRQSPIIRARVAAGKLKVVGAIYHIDDGKVEWLGEHPMQARLLEYTSGPAKAHR

SEQ ID NO: 679 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 680 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVGGSIPMLVAPIVPAVTAVEKSNPKHDRAALVPLVIEANVWQAIDDTMRQSPIIRARVAAGKLKVVGAIYHIDDGKVEWLGEHPMQARLLNYTSGPAKAHR

SEQ ID NO: 681 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttatttgcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 682 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADFLNVPLLVVMGHTQCGAVTAVVQGAEVHGSIPMLFAPIVPAVTAVEKSNPKHDRAALVPKAIEANVWQAIDDTMRQSPIIRARVAAGKLKVVGAIYHIDDGKVEWLGEHPMQARLLNYTSGPAKAHR

SEQ ID NO: 683 - DNA, 672 bp, Artificial Sequence
  Engineered variant of carbonic anhydrase from D. vulgaris
atgggtagctttggaccgggaattggaccagacgaagctttaaggcgtcttaaggaaggaaatgctagatttgtagccgaaacacctaggcgtaaaaacttacgtgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 684 - protein, 223 aa, Artificial Sequence
  Engineered variant of carbonic anhydrase from D. vulgaris
MGSFGPGIGPDEALRRLKEGNARFVAETPRRKNLRAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 685 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttatttgcgccgattgtgcctgcagtaacagctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 686 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLFAPIVPAVTAVEKSNPKHDRAALVPLAIEANVWQAIDDTMRQSPIIRARVAAGKLKVVGAIYHIDDGKVEWLGEHPMQARLLNYTSGPTKAHR

SEQ ID NO: 687 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 688 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 689 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagcgtagcaacccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 690 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVERSNPKTDRAALVPKVIEANVWQAIDDTMRQSPIIRARVAAGKLKVVGAIYHIDDGKVEWLGEHPMQARLLEYTSGPAKAHR

SEQ ID NO: 691 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtagcgattcaagatgcccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccagtaa

SEQ ID NO: 692 - protein, 223 aa, Artificial Sequence
  Engineered variant of carbonic anhydrase from D. vulgaris
MGSTGPGIGPDEALRRLKEGNARFVAETPRRQNHSAKRLATSQHGQTPYATILSCSDSRCPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHQ

SEQ ID NO: 693 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtggggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 694 - protein, 223 aa, Artificial Sequence
  Engineered variant of carbonic anhydrase from D. vulgaris
MGSTGPGIGPDEALRRLKEGNARFVAETPRRQNHSAKRLATSQHGQTPYATILSCADSRAPVELIFDEGVGDLFVIRVAGNVAATDEVGTAEWGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 695 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 696 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVGGSIPMLVAPIVPAVTAVEKSNPKHDRAALVPLVIEANVWQAIDDTMRQSPIIRARVAAGKLKVVGAIYHIDDGKVEWLGEHPMQARLLNYTSGPTKAHR

SEQ ID NO: 697 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcattggcgatctattcgttatccgtgttgcgggcaatgtagcggcgacagatgaagtgggaacagcggagtggggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 698 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGIGDLFVIRVAGNVAATDEVGTAEWGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 699 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttatttgcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 700 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLFAPIVPAVTAVEKSNPKHDRAALVPKAIEANVWQAIDDTMRQSPIIRARVAAGKLKVVGAIYHIDDGKVEWLGEHPMQARLLNYTSGPTKAHR

SEQ ID NO: 701 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcatggacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 702 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAWTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 703 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctaccaaagctcaccgctaa

SEQ ID NO: 704 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKAIEANVWQAIDDTMRQSPIIRARVAAGKLKVVGAIYHIDDGKVRWLGEHPMQARLLNYTSGPTKAHR

SEQ ID NO: 705 - DNA, 672 bp, Artificial Sequence
  Engineered variant of carbonic anhydrase from D. vulgaris
atgggtagcacgggaccgggaattggaccagacgaagctttaaggcgtcttaaggaaggaaatggcagatttgtagccgaaacacctaggcgtcagaaccattctgcaaagcgcctggcgacgtctcaacatggacaaacgccgtatgccacgatcctttcttgtgcggattcaagagcgccagtagagctgatcttcgacgagggcattggcgatctattcgttatccgtgttgcgggcaatgtagcggcgacagatgaagtgggaacagcggagtggggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 706 - protein, 223 aa, Artificial Sequence
  Engineered variant of carbonic anhydrase from D. vulgaris
MGSTGPGIGPDEALRRLKEGNGRFVAETPRRQNHSAKRLATSQHGQTPYATILSCADSRAPVELIFDEGIGDLFVIRVAGNVAATDEVGTAEWGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 707 - DNA, 672 bp, Artificial Sequence
  Engineered variant of carbonic anhydrase from D. vulgaris
atgggtagctttggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 708 - protein, 223 aa, Artificial Sequence
  Engineered variant of carbonic anhydrase from D. vulgaris
MGSFGPGIGPDEALRRLKEGNARFVAETPRRQNHSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 709 - DNA, 672 bp, Artificial Sequence
  Engineered variant of carbonic anhydrase from D. vulgaris
atgggtagctttggaccgggaattggaccagacgaagctttaaggcgtcttaaggaaggaaatgctagatttgtagccgaaacacctaggcgtcgtaaccatcgtgcaaagcgcctggcgacgtctcaacatggacaaacgccgtatgccacgatcctttcttgtagcgattcaagatgcccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 710 - protein, 223 aa, Artificial Sequence
  Engineered variant of carbonic anhydrase from D. vulgaris
MGSFGPGIGPDEALRRLKEGNARFVAETPRRRNHRAKRLATSQHGQTPYATILSCSDSRCPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 711 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctaccaaagctcaccgctaa

SEQ ID NO: 712 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLQYTSGPTKAHR

SEQ ID NO: 713 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 714 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 715 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagagcaacccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctaccaaagctcaccgctaa

SEQ ID NO: 716 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVGGSIPMLVAPIVPAVTAVEKSNPKTDRAALVPKVIEANVWQAIDDTMRQSPIIRARVAAGKLKVVGAIYHIDDGKVEWLGEHPMQARLLQYTSGPTKAHR

SEQ ID NO: 717 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagagcaacccgaaaaccgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 718 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVGGSIPMLVAPIVPAVTAVEKSNPKTDRAALVPLVIEANVWQAIDDTMRQSPIIRARVAAGKLKVVGAIYHIDDGKVEWLGEHPMQARLLNYTSGPTKAHR

SEQ ID NO: 719 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 720 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 721 - DNA, 672 bp, Artificial Sequence
  Engineered variant of carbonic anhydrase from D. vulgaris
atgggtagcacgggaccgggaattggaccagacgaagctttaaggcgtcttaaggaaggaaatggcagatttgtagccgaaacacctaggcgtcagaacttatctgcaaagcgcctgcagacgtctcaacatggacaaacgccgtatgccacgatcctttcttgtgcggattcaagagcgccagtagagctgatcttcgacgagggcattggcgatctattcgttatccgtgttgcgggcaatgtagcggcgacagatgaagtgggaacagcggagtggggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 722 - protein, 223 aa, Artificial Sequence
  Engineered variant of carbonic anhydrase from D. vulgaris
MGSTGPGIGPDEALRRLKEGNGRFVAETPRRQNLSAKRLQTSQHGQTPYATILSCADSRAPVELIFDEGIGDLFVIRVAGNVAATDEVGTAEWGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 723 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcgtaaccatgcggcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 724 - protein, 223 aa, Artificial Sequence
  Engineered variant of carbonic anhydrase from D. vulgaris
MGSTGPGIGPDEALRRLKEGNARFVAETPRRRNHAAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 725 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttagcggcaaagcgcctggcgacgtctcaacatggacaaacgccgtatgccacgatcctttcttgtgcggattcaagatgcccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 726 - protein, 223 aa, Artificial Sequence
  Engineered variant of carbonic anhydrase from D. vulgaris
MGSTGPGIGPDEALRRLKEGNARFVAETPRRQNLAAKRLATSQHGQTPYATILSCADSRCPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 727 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccatgcggcaaagcgcctggcgacgtctcaacatggacaaacgccgtatgccacgatcctttcttgtgcggattcaagagtgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 728 - protein, 223 aa, Artificial Sequence
  Engineered variant of carbonic anhydrase from D. vulgaris
MGSTGPGIGPDEALRRLKEGNARFVAETPRRQNHAAKRLATSQHGQTPYATILSCADSRVPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 729 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttacgtgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctaccaaagctcaccgctaa

SEQ ID NO: 730 - protein, 223 aa, Artificial Sequence
  Engineered variant of carbonic anhydrase from D. vulgaris
MGSTGPGIGPDEALRRLKEGNARFVAETPRRQNLRAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPLAIEANVWQAIDDTMRQSPIIRARVAAGKLKVVGAIYHIDDGKVRWLGEHPMQARLLNYTSGPTKAHR

SEQ ID NO: 731 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcacgtcgcctgctgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtggggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 732 - protein, 223 aa, Artificial Sequence
  Engineered variant of carbonic anhydrase from D. vulgaris
MGSTGPGIGPDEALRRLKEGNARFVAETPRRQNLSARRLLTSQHGQTPYATILSCADSRAPVELIFDEGVGDLFVIRVAGNVAATDEVGTAEWGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 733 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 734 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVGGSIPMLVAPIVPAVTAVEKSNPKHDRAALVPLVIEANVWQAIDDTMRQSPIIRARVAAGKLKVVGAIYHIDDGKVEWLGEHPMQARLLNYTSGPTKAHR

SEQ ID NO: 735 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaagctcaccgctaa

SEQ ID NO: 736 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLQYTSGPAKAHR

SEQ ID NO: 737 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 738 - protein, 223 aa, Artificial Sequence
  Engineered variant of carbonic anhydrase from D. vulgaris
MGSTGPGIGPDEALRRLKEGNARFVAETPRRKNHAAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 739 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaaaccgcagaacttacgtgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 740 - protein, 223 aa, Artificial Sequence
  Engineered variant of carbonic anhydrase from D. vulgaris
MGSTGPGIGPDEALRRLKEGNARFVAETPKPQNLRAKRLATSQHGQTPYATILSCADSRAPVELIFDEGVGDLFVIRVAGNVAATDEVGTAEYGADFLNVPLLVVMGHTQCGAVTAVVQGAEVHGSIPMLVAPIVPAVTAVEKSNPKHDRAALVPKVIVANVWQAIDDTMRQSPIIRARVAAGKLKVVGAIYHIDDGKVEWLGEHPMQARLLNYTSGPAKAHR

SEQ ID NO: 741 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtacatggatcaatcccgatgttagtggcgccgattgtgcctgcagtacatgctgtagagaagagctgcccgaaaaccgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 742 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVHGSIPMLVAPIVPAVHAVEKSCPKTDRAALVPLVIEANVWQAIDDTMRQSPIIRARVAAGKLKVVGAIYHIDDGKVEWLGEHPMQARLLNYTSGPTKAHR

SEQ ID NO: 743 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcattggcgatctattcgttatccgtgttgcgggcaatgtagcggcgacagatgaagtgggaacagcggagtggggagccgaccaccttaacgttcctctgcttgtagtgatgggccatacacaatgcggtgctgtaactgcagtggtacaaggacaggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 744 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGIGDLFVIRVAGNVAATDEVGTAEWGADHLNVPLLVVMGHTQCGAVTAVVQGQEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 745 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtacatgctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctaccaaagctcaccgctaa

SEQ ID NO: 746 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVHAVEKSCPKHDRAALVPKVIEANVWQAIDDTMRQSPIIRARVAAGKLKVVGAIYHIDDGKVEWLGEHPMQARLLQYTSGPTKAHR

SEQ ID NO: 747 - DNA, 672 bp, Artificial Sequence
  Engineered variant of carbonic anhydrase from D. vulgaris
atgggtagctttggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 748 - protein, 223 aa, Artificial Sequence
  Engineered variant of carbonic anhydrase from D. vulgaris
MGSFGPGIGPDEALRRLKEGNARFVAETPRRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 749 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagagtgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 750 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCSDSRVPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 751 - DNA, 672 bp, Artificial Sequence
  Engineered variant of carbonic anhydrase from D. vulgaris
atgggtagcacgggaccgggaattggaccagacgaagctttaaggcgtcttaaggaaggaaatggcagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 752 - protein, 223 aa, Artificial Sequence
  Engineered variant of carbonic anhydrase from D. vulgaris
MGSTGPGIGPDEALRRLKEGNGRFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 753 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtgcggattcaagagtgccagtagagctgatcttcgacgagggcgtaggcgatctattcgttatccgtgttgcgggcaatgtagcgcgtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 754 - protein, 223 aa, Artificial Sequence
  Engineered variant of carbonic anhydrase from D. vulgaris
MGSTGPGIGPDEALRRLKEGNARFVAETPRRQNHSAKRLATSQHGQTPYATILSCADSRVPVELIFDEGVGDLFVIRVAGNVARTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 755 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagtgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 756 - protein, 223 aa, Artificial Sequence
  Engineered variant of carbonic anhydrase from D. vulgaris
MGSMGPGIGPDEALRRLKEGNARFVAETPRRQNLSAKRLATSQHGQTPYATILSCADSRVPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 757 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtacaggctgtagagcgtagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaagctcaccgctaa

SEQ ID NO: 758 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVQAVERSNPKHDRAALVPLVIEANVWQAIDDTMRQSPIIRARVAAGKLKVVGAIYHIDDGKVEWLGEHPMQARLLQYTSGPAKAHR

SEQ ID NO: 759 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagctcaccgctaa

SEQ ID NO: 760 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLLAPIVPAVTAVEKSNPKHDRAALVPLVIEANVWQAIDDTMRQSPIIRARVAAGKLKVVGAIYHIDDGKVRWLGEHPMQARLLNYTSGPAKAHR

SEQ ID NO: 761 - DNA, 672 bp, Artificial Sequence
  Engineered variant of carbonic anhydrase from D. vulgaris
atgggtagctttggaccgggaattggaccagacgaagctttaaggcgtcttaaggaaggaaatgctagatttgtagccgaaacacctaggcgtaaaaaccattctgcaaagcgcctggcgacgtctcaacatggacaaacgccgtatgccacgatcctttcttgtagcgattcaagagtgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 762 - protein, 223 aa, Artificial Sequence
  Engineered variant of carbonic anhydrase from D. vulgaris
MGSFGPGIGPDEALRRLKEGNARFVAETPRRKNHSAKRLATSQHGQTPYATILSCSDSRVPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 763 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtaggcggatcaatcccgatgttagtggcgccgattgtgcctgcagtacaggctgtagagcgtagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 764 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVGGSIPMLVAPIVPAVQAVERSNPKHDRAALVPLVIEANVWQAIDDTMRQSPIIRARVAAGKLKVVGAIYHIDDGKVEWLGEHPMQARLLNYTSGPAKAHR

SEQ ID NO: 765 - DNA, 672 bp, Artificial Sequence
  Engineered variant of carbonic anhydrase from D. vulgaris
atgggtagctttggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagtgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 766 - protein, 223 aa, Artificial Sequence
  Engineered variant of carbonic anhydrase from D. vulgaris
MGSFGPGIGPDEALRRLKEGNARFVAETPRRQNLSAKRLATSQHGQTPYATILSCADSRVPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 767 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 768 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVGGSIPMLVAPIVPAVTAVEKSNPKHDRAALVPLVIEANVWQAIDDTMRQSPIIRARVAAGKLKVVGAIYHIDDGKVEWLGEHPMQARLLNYTSGPAKAHR

SEQ ID NO: 769 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttatctgcaaagcgcctggcgacgtctcaacatggacaaacgccgtatgccacgatcctttcttgtagcgattcaagatgcccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 770 - protein, 223 aa, Artificial Sequence
  Engineered variant of carbonic anhydrase from D. vulgaris
MGSMGPGIGPDEALRRLKEGNARFVAETPRRKNLSAKRLATSQHGQTPYATILSCSDSRCPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 771 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtcagaaccatcgtgcaaagcgcctggcgacgtctcaacatggacaaacgccgtatgccacgatcctttcttgtgcggattcaagagtgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 772 - protein, 223 aa, Artificial Sequence
  Engineered variant of carbonic anhydrase from D. vulgaris
MGSMGPGIGPDEALRRLKEGNARFVAETPRRQNHRAKRLATSQHGQTPYATILSCADSRVPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 773 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtcagaacttagcggcaaagcgcctggcgacgtctcaacatggacaaacgccgtatgccacgatcctttcttgtgcggattcaagatgcccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 774 - protein, 223 aa, Artificial Sequence
  Engineered variant of carbonic anhydrase from D. vulgaris
MGSMGPGIGPDEALRRLKEGNARFVAETPRRQNLAAKRLATSQHGQTPYATILSCADSRCPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 775 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtactgaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctaccaaagctcaccgctaa

SEQ ID NO: 776 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVLKSNPKHDRAALVPKVIEANVWQAIDDTMRQSPIIRARVAAGKLKVVGAIYHIDDGKVEWLGEHPMQARLLQYTSGPTKAHR

SEQ ID NO: 777 - DNA, 672 bp, Artificial Sequence
  Engineered variant of carbonic anhydrase from D. vulgaris
atgggtagctttggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 778 - protein, 223 aa, Artificial Sequence
  Engineered variant of carbonic anhydrase from D. vulgaris
MGSFGPGIGPDEALRRLKEGNARFVAETPRRQNHSAKRLATSQHGQTPYATILSCSDSRAPVELIFDEGVGDLFVIRVAGNVANTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 779 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 780 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVHGSIPMLVAPIVPAVTAVEKSCPKHDRAALVPKVIEANVWQAIDDTMRQSPIIRARVAAGKLKVVGAIYHIDDGKVEWLGEHPMQARLLEYTSGPAKAHR

SEQ ID NO: 781 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaacgtccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgctggtgatcgtggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctaccaaagctcaccgctaa

SEQ ID NO: 782 - protein, 223 aa, Artificial Sequence
  Engineered variant of carbonic anhydrase from D. vulgaris
MGSTGPGIGPDEALRRLKEGNARFVAETPRRQNLSAKRLATSQHGQRPYATILSCADSRAPVELIFDEGVGDLFVIRVAGNVAATDEVGTAEYGADFLNVPLLVVMGHTQCGAVTAVVQGAEVHGSIPMLLAPIVPAVTAVEKSNPKHDRAALVPLVIVANVWQAIDDTMRQSPIIRARVAAGKLKVVGAIYHIDDGKVRWLGEHPMQARLLNYTSGPTKAHR

SEQ ID NO: 783 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaacgtccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 784 - protein, 223 aa, Artificial Sequence
  Engineered variant of carbonic anhydrase from D. vulgaris
MGSTGPGIGPDEALRRLKEGNARFVAETPRRQNLSAKRLATSQHGQRPYATILSCADSRAPVELIFDEGVGDLFVIRVAGNVAATDEVGTAEYGADFLNVPLLVVMGHTQCGAVTAVVQGAEVHGSIPMLVAPIVPAVTAVEKSNPKHDRAALVPLAIEANVWQAIDDTMRQSPIIRARVAAGKLKVVGAIYHIDDGKVEWLGEHPMQARLLNYTSGPAKAHR

SEQ ID NO: 785 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctaccaaagctcaccgctaa

SEQ ID NO: 786 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADFLNVPLLVVMGHTQCGAVTAVVQGAEVHGSIPMLVAPIVPAVTAVEKSNPKHDRAALVPLAIEANVWQAIDDTMRQSPIIRARVAAGKLKVVGAIYHIDDGKVRWLGEHPMQARLLNYTSGPTKAHR

SEQ ID NO: 787 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttatctgcaaagcgcctggcgacgtctcaacatggacaaacgccgtatgccacgatcctttcttgtagcgattcaagagtgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 788 - protein, 223 aa, Artificial Sequence
  Engineered variant of carbonic anhydrase from D. vulgaris
MGSTGPGIGPDEALRRLKEGNARFVAETPRRKNLSAKRLATSQHGQTPYATILSCSDSRVPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 789 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacggcgcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 790 - protein, 223 aa, Artificial Sequence
  Engineered variant of carbonic anhydrase from D. vulgaris
MGSTGPGIGPDEALRRLKEGNARFVAETPRRQNLSAKRLATAQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPLAIEANVWQAIDDTMRQSPIIRARVAAGKLKVVGAIYHIDDGKVEWLGEHPMQARLLNYTSGPTKAHR

SEQ ID NO: 791 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcgtaacttacgtgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 792 - protein, 223 aa, Artificial Sequence
  Engineered variant of carbonic anhydrase from D. vulgaris
MGSTGPGIGPDEALRRLKEGNARFVAETPRRRNLRAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 793 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaacgtccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctaccaaagctcaccgctaa

SEQ ID NO: 794 - protein, 223 aa, Artificial Sequence
  Engineered variant of carbonic anhydrase from D. vulgaris
MRSTGPGIGPDEALRRLKEGNARFVAETPRRQNLSAKRLATSQHGQRPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPLAIEANVWQAIDDTMRQSPIIRARVAAGKLKVVGAIYHIDDGKVRWLGEHPMQARLLNYTSGPTKAHR

SEQ ID NO: 795 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcgtaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 796 - protein, 223 aa, Artificial Sequence
  Engineered variant of carbonic anhydrase from D. vulgaris
MGSTGPGIGPDEALRRLKEGNARFVAETPRRRNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 797 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggccgcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 798 - protein, 223 aa, Artificial Sequence
  Engineered variant of carbonic anhydrase from D. vulgaris
MGSTGPGIGPDEALRRLKEGNARFVAETPRPQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLLAPIVPAVTAVEKSNPKHDRAALVPKAIEANVWQAIDDTMRQSPIIRARVAAGKLKVVGAIYHIDDGKVEWLGEHPMQARLLNYTSGPTKAHR

SEQ ID NO: 799 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccatgcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 800 - protein, 223 aa, Artificial Sequence
  Engineered variant of carbonic anhydrase from D. vulgaris
MGSTGPGIGPDEALRRLKEGNARFVAETPRRQNHAAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 801 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtcgtaaccattctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 802 - protein, 223 aa, Artificial Sequence
  Engineered variant of carbonic anhydrase from D. vulgaris
MGSMGPGIGPDEALRRLKEGNARFVAETPRRRNHSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 803 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggccgcagaacttatctgcaaagcgcctggcgacggcgcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 804 - protein, 223 aa, Artificial Sequence
  Engineered variant of carbonic anhydrase from D. vulgaris
MGSTGPGIGPDEALRRLKEGNARFVAETPRPQNLSAKRLATAQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPLVIEANVWQAIDDTMRQSPIIRARVAAGKLKVVGAIYHIDDGKVEWLGEHPMQARLLNYTSGPAKAHR

SEQ ID NO: 805 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtacaggctgtagagaagagctgcccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 806 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVQAVEKSCPKHDRAALVPLVIEANVWQAIDDTMRQSPIIRARVAAGKLKVVGAIYHIDDGKVEWLGEHPMQARLLNYTSGPTKAHR

SEQ ID NO: 807 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtggggagtggaccaccttaacgttcctctgcttgtagtgatgggccatacacaatgcggtgctgtaactgcagtggtacaaggacaggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 808 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEWGVDHLNVPLLVVMGHTQCGAVTAVVQGQEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 809 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcacgtcgcctgcagacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 810 - protein, 223 aa, Artificial Sequence
  Engineered variant of carbonic anhydrase from D. vulgaris
MGSTGPGIGPDEALRRLKEGNARFVAETPRRQNLSARRLQTSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 811 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 812 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGVGDLFVIRVAGNVANTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 813 - DNA, 672 bp, Artificial Sequence
  Engineered variant of carbonic anhydrase from D. vulgaris
atgggtagcacgggaccgggaattggaccagacgaagctttaaggcgtcttaaggaaggaaatggcagatttgtagccgaaacacctaggcgtcagaaccattctgcaaagcgcctgctgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 814 - protein, 223 aa, Artificial Sequence
  Engineered variant of carbonic anhydrase from D. vulgaris
MGSTGPGIGPDEALRRLKEGNGRFVAETPRRQNHSAKRLLTSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 815 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 816 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADFLNVPLLVVMGHTQCGAVTAVVQGAEVHGSIPMLLAPIVPAVTAVEKSNPKHDRAALVPLAIEANVWQAIDDTMRQSPIIRARVAAGKLKVVGAIYHIDDGKVEWLGEHPMQARLLNYTSGPAKAHR

SEQ ID NO: 817 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtaggcggatcaatcccgatgttagtggcgccgattgtgcctgcagtacaggctgtagagaagagctgcccgaaatgcgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 818 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVGGSIPMLVAPIVPAVQAVEKSCPKCDRAALVPKVIEANVWQAIDDTMRQSPIIRARVAAGKLKVVGAIYHIDDGKVEWLGEHPMQARLLEYTSGPAKAHR

SEQ ID NO: 819 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctgtggacgtctcaacatggacaaacgccgtatgccacgatcctttcttgtgcggattcaagagcgccagtagagctgatcttcgacggcggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 820 - protein, 223 aa, Artificial Sequence
  Engineered variant of carbonic anhydrase from D. vulgaris
MGSTGPGIGPDEALRRLKEGNARFVAETPRRQNLSAKRLWTSQHGQTPYATILSCADSRAPVELIFDGGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 821 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtacatggatcaatcccgatgttagtggcgccgattgtgcctgcagtacatgctgtagagcgtagctgcccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaagctcaccgctaa

SEQ ID NO: 822 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVHGSIPMLVAPIVPAVHAVERSCPKTDRAALVPKVIEANVWQAIDDTMRQSPIIRARVAAGKLKVVGAIYHIDDGKVEWLGEHPMQARLLQYTSGPAKAHR

SEQ ID NO: 823 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaaccattctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 824 - protein, 223 aa, Artificial Sequence
  Engineered variant of carbonic anhydrase from D. vulgaris
MGSTGPGIGPDEALRRLKEGNARFVAETPRRKNHSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 825 - DNA, 672 bp, Artificial Sequence
  Engineered variant of carbonic anhydrase from D. vulgaris
atgggtagcacgggaccgggaattggaccagacgaagctttaaggcgtcttaaggaaggaaatggcagatttgtagccgaaacacctaggcgtcagaaccattctgcaaagcgcctgtggacgtctcaacatggacaaacgccgtatgccacgatcctttcttgtgcggattcaagagcgccagtagagctgatcttcgacgagggcattggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggaaccgaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 826 - protein, 223 aa, Artificial Sequence
  Engineered variant of carbonic anhydrase from D. vulgaris
MGSTGPGIGPDEALRRLKEGNGRFVAETPRRQNHSAKRLWTSQHGQTPYATILSCADSRAPVELIFDEGIGDLFVIRVAGNVAATDEVGTAEYGADHLNVPLLVVMGHTQCGAVTAVVQGTEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 827 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtacatggatcaatcccgatgttagtggcgccgattgtgcctgcagtaacagctgtactgaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctaccaaagctcaccgctaa

SEQ ID NO: 828 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVHGSIPMLVAPIVPAVTAVLKSCPKHDRAALVPKVIEANVWQAIDDTMRQSPIIRARVAAGKLKVVGAIYHIDDGKVEWLGEHPMQARLLQYTSGPTKAHR

SEQ ID NO: 829 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaaaccgcagaacttatctgcaaagcgcctggcgacggcgcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 830 - protein, 223 aa, Artificial Sequence
  Engineered variant of carbonic anhydrase from D. vulgaris
MGSTGPGIGPDEALRRLKEGNARFVAETPKPQNLSAKRLATAQHGQTPYATILSCADSRAPVELIFDEGVGDLFVIRVAGNVAATDEVGTAEYGADFLNVPLLVVMGHTQCGAVTAVVQGAEVHGSIPMLLAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 831 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagatgcccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 832 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCSDSRCPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 833 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcacgtcgcctgctgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 834 - protein, 223 aa, Artificial Sequence
  Engineered variant of carbonic anhydrase from D. vulgaris
MGSTGPGIGPDEALRRLKEGNARFVAETPRRQNLSARRLLTSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 835 - DNA, 672 bp, Artificial Sequence
  Engineered variant of carbonic anhydrase from D. vulgaris
atgggtagctttggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 836 - protein, 223 aa, Artificial Sequence
  Engineered variant of carbonic anhydrase from D. vulgaris
MGSFGPGIGPDEALRRLKEGNARFVAETPRRQNLSAKRLATSQHGQTPYATILSCSDSRAPVELIFDEGVGDLFVIRVAGNVANTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 837 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 838 - protein, 223 aa, Artificial Sequence
  Engineered variant of carbonic anhydrase from D. vulgaris
MGSTGPGIGPDEALRRLKEGNARFVAETPRRQNHSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 839 - DNA, 672 bp, Artificial Sequence
  Engineered variant of carbonic anhydrase from D. vulgaris
atgggtagcacgggaccgggaattggaccagacgaagctttaaggcgtcttaaggaaggaaatggcagatttgtagccgaaacacctaggcgtcagaacttatctgcaaagcgcctgctgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 840 - protein, 223 aa, Artificial Sequence
  Engineered variant of carbonic anhydrase from D. vulgaris
MGSTGPGIGPDEALRRLKEGNGRFVAETPRRQNLSAKRLLTSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 841 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 842 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVGGSIPMLVAPIVPAVTAVEKSNPKHDRAALVPLVIEANVWQAIDDTMRQSPIIRARVAAGKLKVVGAIYHIDDGKVEWLGEHPMQARLLEYTSGPTKAHR

SEQ ID NO: 843 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 844 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVHGSIPMLVAPIVPAVTAVEKSNPKHDRAALVPLVIEANVWQAIDDTMRQSPIIRARVAAGKLKVVGAIYHIDDGKVEWLGEHPMQARLLEYTSGPAKAHR

SEQ ID NO: 845 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcattggcgatctattcgttatccgtgttgcgggcaatgtagcggcgacagatgaagtgggaacagcggagtggggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 846 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGIGDLFVIRVAGNVAATDEVGTAEWGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 847 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggccgcagaacttatctgcaaagcgcctggcgacggcgcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 848 - protein, 223 aa, Artificial Sequence
  Engineered variant of carbonic anhydrase from D. vulgaris
MRSTGPGIGPDEALRRLKEGNARFVAETPRPQNLSAKRLATAQHGQTPYATILSCADSRAPVELIFDEGVGDLFVIRVAGNVAATDEVGTAEYGADHLNVPLLVVMGHTQCGAVTAVVQGAEVHGSIPMLLAPIVPAVTAVEKSNPKHDRAALVPKAIEANVWQAIDDTMRQSPIIRARVAAGKLKVVGAIYHIDDGKVEWLGEHPMQARLLNYTSGPTKAHR

SEQ ID NO: 849 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 850 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLLAPIVPAVTAVEKSNPKHDRAALVPLAIEANVWQAIDDTMRQSPIIRARVAAGKLKVVGAIYHIDDGKVEWLGEHPMQARLLNYTSGPAKAHR

SEQ ID NO: 851 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtaggcggatcaatcccgatgttagtggcgccgattgtgcctgcagtacatgctgtactgaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 852 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVGGSIPMLVAPIVPAVHAVLKSNPKHDRAALVPKVIEANVWQAIDDTMRQSPIIRARVAAGKLKVVGAIYHIDDGKVEWLGEHPMQARLLEYTSGPTKAHR

SEQ ID NO: 853 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctgcagacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcatggacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 854 - protein, 223 aa, Artificial Sequence
  Engineered variant of carbonic anhydrase from D. vulgaris
MGSTGPGIGPDEALRRLKEGNARFVAETPRRQNLSAKRLQTSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAWTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 855 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtgcggattcaagagcgccagtagagctgatcttcgacgcgggcattggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 856 - protein, 223 aa, Artificial Sequence
  Engineered variant of carbonic anhydrase from D. vulgaris
MGSTGPGIGPDEALRRLKEGNARFVAETPRRQNHSAKRLATSQHGQTPYATILSCADSRAPVELIFDAGIGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 857 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcattggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 858 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGIGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 859 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcaaagcgcctgctgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 860 - protein, 223 aa, Artificial Sequence
  Engineered variant of carbonic anhydrase from D. vulgaris
MGSTGPGIGPDEALRRLKEGNARFVAETPRRQNHSAKRLLTSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 861 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 862 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 863 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcgtaacttacgtgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccagtaa

SEQ ID NO: 864 - protein, 223 aa, Artificial Sequence
  Engineered variant of carbonic anhydrase from D. vulgaris
MGSTGPGIGPDEALRRLKEGNARFVAETPRRRNLRAKRLATSQHGQTPYATILSCADSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHQ

SEQ ID NO: 865 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaatgcgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaagctcaccgctaa

SEQ ID NO: 866 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVHGSIPMLVAPIVPAVTAVEKSNPKCDRAALVPLVIEANVWQAIDDTMRQSPIIRARVAAGKLKVVGAIYHIDDGKVEWLGEHPMQARLLQYTSGPAKAHR

SEQ ID NO: 867 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttagcggcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgaacacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 868 - protein, 223 aa, Artificial Sequence
  Engineered variant of carbonic anhydrase from D. vulgaris
MGSTGPGIGPDEALRRLKEGNARFVAETPRRQNLAAKRLATSQHGQTPYATILSCADSRAPVELIFDEGVGDLFVIRVAGNVANTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 869 - DNA, 672 bp, Artificial Sequence
  Engineered variant of carbonic anhydrase from D. vulgaris
atgggtagctttggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagtgccagtagagctgatcttcgacgagggcgtaggcgatctattcgttatccgtgttgcgggcaatgtagcgaaaacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 870 - protein, 223 aa, Artificial Sequence
  Engineered variant of carbonic anhydrase from D. vulgaris
MGSFGPGIGPDEALRRLKEGNARFVAETPRRKNHAAKRLATSQHGQTPYATILSCSDSRVPVELIFDEGVGDLFVIRVAGNVAKTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 871 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagctcaccgctaa

SEQ ID NO: 872 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLLAPIVPAVTAVEKSNPKHDRAALVPKAIEANVWQAIDDTMRQSPIIRARVAAGKLKVVGAIYHIDDGKVRWLGEHPMQARLLNYTSGPAKAHR

SEQ ID NO: 873 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctgcgccgcagaacttagcggcaaagcgcctggcgacgtctcaacatggacaacgtccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 874 - protein, 223 aa, Artificial Sequence
  Engineered variant of carbonic anhydrase from D. vulgaris
MGSTGPGIGPDEALRRLKEGNARFVAETPAPQNLAAKRLATSQHGQRPYATILSCADSRAPVELIFDEGVGDLFVIRVAGNVAATDEVGTAEYGADFLNVPLLVVMGHTQCGAVTAVVQGAEVHGSIPMLLAPIVPAVTAVEKSNPKHDRAALVPLAIEANVWQAIDDTMRQSPIIRARVAAGKLKVVGAIYHIDDGKVEWLGEHPMQARLLNYTSGPAKAHR

SEQ ID NO: 875 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgcgtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 876 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVARTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 877 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctgcgccgcagaacttacgtgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 878 - protein, 223 aa, Artificial Sequence
  Engineered variant of carbonic anhydrase from D. vulgaris
MGSTGPGIGPDEALRRLKEGNARFVAETPAPQNLRAKRLATSQHGQTPYATILSCADSRAPVELIFDEGVGDLFVIRVAGNVAATDEVGTAEYGADFLNVPLLVVMGHTQCGAVTAVVQGAEVHGSIPMLLAPIVPAVTAVEKSNPKHDRAALVPKAIEANVWQAIDDTMRQSPIIRARVAAGKLKVVGAIYHIDDGKVEWLGEHPMQARLLNYTSGPAKAHR

SEQ ID NO: 879 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 880 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 881 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggccgcagaacttagcggcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctaccaaagctcaccgctaa

SEQ ID NO: 882 - protein, 223 aa, Artificial Sequence
  Engineered variant of carbonic anhydrase from D. vulgaris
MGSTGPGIGPDEALRRLKEGNARFVAETPRPQNLAAKRLATSQHGQTPYATILSCADSRAPVELIFDEGVGDLFVIRVAGNVAATDEVGTAEYGADHLNVPLLVVMGHTQCGAVTAVVQGAEVHGSIPMLLAPIVPAVTAVEKSNPKHDRAALVPLAIEANVWQAIDDTMRQSPIIRARVAAGKLKVVGAIYHIDDGKVEWLGEHPMQARLLNYTSGPTKAHR

SEQ ID NO: 883 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcatgtcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 884 - protein, 223 aa, Artificial Sequence
  Engineered variant of carbonic anhydrase from D. vulgaris
MGSTGPGIGPDEALRRLKEGNARFVAETPRRQNHSACRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 885 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccatcgtgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgcgtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 886 - protein, 223 aa, Artificial Sequence
  Engineered variant of carbonic anhydrase from D. vulgaris
MGSTGPGIGPDEALRRLKEGNARFVAETPRRQNHRAKRLATSQHGQTPYATILSCADSRAPVELIFDEGVGDLFVIRVAGNVARTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 887 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcacgtcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 888 - protein, 223 aa, Artificial Sequence
  Engineered variant of carbonic anhydrase from D. vulgaris
MGSTGPGIGPDEALRRLKEGNARFVAETPRRQNHSARRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 889 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttacgtgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccagtaa

SEQ ID NO: 890 - protein, 223 aa, Artificial Sequence
  Engineered variant of carbonic anhydrase from D. vulgaris
MGSMGPGIGPDEALRRLKEGNARFVAETPRRKNLRAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHQ

SEQ ID NO: 891 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttatctgcaaagcgcctggcgacgtctcaacatggacaaacgccgtatgccacgatcctttcttgtagcgattcaagagtgccagtagagctgatcttcgacgagggcgtaggcgatctattcgttatccgtgttgcgggcaatgtagcgaaaacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 892 - protein, 223 aa, Artificial Sequence
  Engineered variant of carbonic anhydrase from D. vulgaris
MGSTGPGIGPDEALRRLKEGNARFVAETPRRKNLSAKRLATSQHGQTPYATILSCSDSRVPVELIFDEGVGDLFVIRVAGNVAKTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 893 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtacaggctgtagagcgtagctgcccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaagctcaccgctaa

SEQ ID NO: 894 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVQAVERSCPKHDRAALVPLVIEANVWQAIDDTMRQSPIIRARVAAGKLKVVGAIYHIDDGKVEWLGEHPMQARLLQYTSGPAKAHR

SEQ ID NO: 895 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 896 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 897 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtaggcggatcaatcccgatgttagtggcgccgattgtgcctgcagtacatgctgtagagcgtagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaagctcaccgctaa

SEQ ID NO: 898 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVGGSIPMLVAPIVPAVHAVERSCPKHDRAALVPKVIEANVWQAIDDTMRQSPIIRARVAAGKLKVVGAIYHIDDGKVEWLGEHPMQARLLEYTSGPAKAHR

SEQ ID NO: 899 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcacgtcgcctgcagacgtctcaacatggacaaacgccgtatgccacgatcctttcttgtgcggattcaagagcgccagtagagctgatcttcgacgtgggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 900 - protein, 223 aa, Artificial Sequence
  Engineered variant of carbonic anhydrase from D. vulgaris
MGSTGPGIGPDEALRRLKEGNARFVAETPRRQNLSARRLQTSQHGQTPYATILSCADSRAPVELIFDVGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 901 - DNA, 672 bp, Artificial Sequence
  Engineered variant of carbonic anhydrase from D. vulgaris
atgggtagcacgggaccgggaattggaccagacgaagctttaaggcgtcttaaggaaggaaatggcagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgcgggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 902 - protein, 223 aa, Artificial Sequence
  Engineered variant of carbonic anhydrase from D. vulgaris
MGSTGPGIGPDEALRRLKEGNGRFVAETPRRQNLSAKRLATSQHGQTPYATILSCADSRAPVELIFDAGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 903 - DNA, 672 bp, Artificial Sequence
  Engineered variant of carbonic anhydrase from D. vulgaris
  unsure (49)..(49): n = a, c, g or t
  misc_feature (49)..(49): n is a, c, g, or t
atgggtagcacgggaccgggaattggaccagacgaagctttaaggcgtnttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgaacacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 904 - protein, 223 aa, Artificial Sequence
  Engineered variant of carbonic anhydrase from D. vulgaris
  unsure (17)..(17): Xaa = Phe, Ile, Leu, Val
MGSTGPGIGPDEALRRXKEGNARFVAETPRRQNLSAKRLATSQHGQTPYATILSCADSRAPVELIFDEGVGDLFVIRVAGNVANTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 905 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtcagaacttacgtgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 906 - protein, 223 aa, Artificial Sequence
  Engineered variant of carbonic anhydrase from D. vulgaris
MGSMGPGIGPDEALRRLKEGNARFVAETPRRQNLRAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 907 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggccgcagaacttacgtgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgactttcttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgctggcgatcgtggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactgaactacacatctggacctgctaaagctcaccgctaa

SEQ ID NO: 908 - protein, 223 aa, Artificial Sequence
  Engineered variant of carbonic anhydrase from D. vulgaris
MGSTGPGIGPDEALRRLKEGNARFVAETPRPQNLRAKRLATSQHGQTPYATILSCADSRAPVELIFDEGVGDLFVIRVAGNVAATDEVGTAEYGADFLNVPLLVVMGHTQCGAVTAVVQGAEVHGSIPMLLAPIVPAVTAVEKSNPKHDRAALVPLAIVANVWQAIDDTMRQSPIIRARVAAGKLKVVGAIYHIDDGKVRWLGEHPMQARLLNYTSGPAKAHR

SEQ ID NO: 909 - DNA, 672 bp, Artificial Sequence
  Engineered variant of carbonic anhydrase from D. vulgaris
atgggtagcacgggaccgggaattggaccagacgaagctttaaggcgtcttaaggaaggaaatggcagatttgtagccgaaacacctaggcgtcagaacttatctgcaaagcgcctgtggacgtctcaacatggacaaacgccgtatgccacgatcctttcttgtgcggattcaagagcgccagtagagctgatcttcgacgcgggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 910 - protein, 223 aa, Artificial Sequence
  Engineered variant of carbonic anhydrase from D. vulgaris
MGSTGPGIGPDEALRRLKEGNGRFVAETPRRQNLSAKRLWTSQHGQTPYATILSCADSRAPVELIFDAGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 911 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttacgtgcaaagcgcctggcgacgtctcaacatggacaaacgccgtatgccacgatcctttcttgtagcgattcaagagtgccagtagagctgatcttcgacgagggcgtaggcgatctattcgttatccgtgttgcgggcaatgtagcgaaaacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 912 - protein, 223 aa, Artificial Sequence
  Engineered variant of carbonic anhydrase from D. vulgaris
MGSTGPGIGPDEALRRLKEGNARFVAETPRRQNLRAKRLATSQHGQTPYATILSCSDSRVPVELIFDEGVGDLFVIRVAGNVAKTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 913 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 914 - protein, 223 aa, Artificial Sequence
  Engineered variant of carbonic anhydrase from D. vulgaris
MGSTGPGIGPDEALRRLKEGNARFVAETPRRKNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 915 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 916 - protein, 223 aa, Artificial Sequence
  Engineered variant of carbonic anhydrase from D. vulgaris
MGSMGPGIGPDEALRRLKEGNARFVAETPRRQNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 917 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcgtaaccattctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 918 - protein, 223 aa, Artificial Sequence
  Engineered variant of carbonic anhydrase from D. vulgaris
MGSTGPGIGPDEALRRLKEGNARFVAETPRRRNHSAKRLATSQHGQTPYATILSCSDSRAPVELIFDEGVGDLFVIRVAGNVANTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 919 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcacgtcgcctgctgacgtctcaacatggacaaacgccgtatgccacgatcctttcttgtgcggattcaagagcgccagtagagctgatcttcgacgagggcattggcgatctattcgttatccgtgttgcgggcaatgtagcggcgacagatgaagtgggaacagcggagtacggagtggaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 920 - protein, 223 aa, Artificial Sequence
  Engineered variant of carbonic anhydrase from D. vulgaris
MGSTGPGIGPDEALRRLKEGNARFVAETPRRQNLSARRLLTSQHGQTPYATILSCADSRAPVELIFDEGIGDLFVIRVAGNVAATDEVGTAEYGVDHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHR

SEQ ID NO: 921 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcatttacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 922 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAFTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 923 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggaaaagaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 924 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGKEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 925 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtagagcgtagctgcccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaagctcaccgctaa

SEQ ID NO: 926 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVGGSIPMLVAPIVPAVTAVERSCPKTDRAALVPKVIEANVWQAIDDTMRQSPIIRARVAAGKLKVVGAIYHIDDGKVEWLGEHPMQARLLQYTSGPAKAHR

SEQ ID NO: 927 - DNA, 672 bp, Artificial Sequence
  Engineered variant of carbonic anhydrase from D. vulgaris
atgggtagctttggaccgggaattggaccagacgaagctttaaggcgtcttaaggaaggaaatgctagatttgtagccgaaacacctaggcgtcgtaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 928 - protein, 223 aa, Artificial Sequence
  Engineered variant of carbonic anhydrase from D. vulgaris
MGSFGPGIGPDEALRRLKEGNARFVAETPRRRNLSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 929 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcatggacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 930 - protein, 223 aa, Artificial Sequence
  Engineered variant of carbonic anhydrase from D. vulgaris
MGSTGPGIGPDEALRRLKEGNARFVAETPRRQNHSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAWTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 931 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaaaacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 932 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCSDSRAPVELIFDEGVGDLFVIRVAGNVAKTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 933 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 934 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCSDSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 935 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcgtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 936 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCSDSRAPVELIFDEGVGDLFVIRVAGNVARTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 937 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 938 - protein, 223 aa, Artificial Sequence
  Engineered variant of carbonic anhydrase from D. vulgaris
MGSTGPGIGPDEALRRLKEGNARFVAETPRRQNHSAKRLATSQHGQTPYATILSCADSRAPVELIFDEGVGDLFVIRVAGNVAQTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 939 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggccgcagaacttacgtgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 940 - protein, 223 aa, Artificial Sequence
  Engineered variant of carbonic anhydrase from D. vulgaris
MGSTGPGIGPDEALRRLKEGNARFVAETPRPQNLRAKRLATSQHGQTPYATILSCADSRAPVELIFDEGVGDLFVIRVAGNVAATDEVGTAEYGADHLNVPLLVVMGHTQCGAVTAVVQGAEVHGSIPMLLAPIVPAVTAVEKSNPKHDRAALVPKAIEANVWQAIDDTMRQSPIIRARVAAGKLKVVGAIYHIDDGKVEWLGEHPMQARLLNYTSGPAKAHR

SEQ ID NO: 941 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcatggacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 942 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAWTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 943 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcattggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 944 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGIGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 945 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtcgtaaccattctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaaaacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 946 - protein, 223 aa, Artificial Sequence
  Engineered variant of carbonic anhydrase from D. vulgaris
MGSMGPGIGPDEALRRLKEGNARFVAETPRRRNHSAKRLATSQHGQTPYATILSCSDSRAPVELIFDEGVGDLFVIRVAGNVAKTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 947 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 948 - protein, 223 aa, Artificial Sequence
  Engineered variant of carbonic anhydrase from D. vulgaris
MGSMGPGIGPDEALRRLKEGNARFVAETPRRQNHSAKRLATSQHGQTPYATILSCSDSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 949 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagcttgccgctaa

SEQ ID NO: 950 - protein, 223 aa, Artificial Sequence
  Engineered variant of carbonic anhydrase from D. vulgaris
MGSTGPGIGPDEALRRLKEGNARFVAETPRRQNHSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKACR

SEQ ID NO: 951 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgaacacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 952 - protein, 223 aa, Artificial Sequence
  Engineered variant of carbonic anhydrase from D. vulgaris
MGSMGPGIGPDEALRRLKEGNARFVAETPRRKNLSAKRLATSQHGQTPYATILSCADSRAPVELIFDEGVGDLFVIRVAGNVANTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 953 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgaacacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 954 - protein, 223 aa, Artificial Sequence
  Engineered variant of carbonic anhydrase from D. vulgaris
MGSMGPGIGPDEALRRLKEGNARFVAETPRRQNLSAKRLATSQHGQTPYATILSCADSRAPVELIFDEGVGDLFVIRVAGNVANTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 955 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttagtggcgccgattgtgcctgcagtacatgctgtagagaagagctgcccgaaaaccgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 956 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVGGSIPMLVAPIVPAVHAVEKSCPKTDRAALVPLVIEANVWQAIDDTMRQSPIIRARVAAGKLKVVGAIYHIDDGKVEWLGEHPMQARLLNYTSGPAKAHR

SEQ ID NO: 957 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttacgtgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcgtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 958 - protein, 223 aa, Artificial Sequence
  Engineered variant of carbonic anhydrase from D. vulgaris
MGSTGPGIGPDEALRRLKEGNARFVAETPRRQNLRAKRLATSQHGQTPYATILSCSDSRAPVELIFDEGVGDLFVIRVAGNVARTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 959 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaaccattctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcgcgtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcactgctaa

SEQ ID NO: 960 - protein, 223 aa, Artificial Sequence
  Engineered variant of carbonic anhydrase from D. vulgaris
MGSTGPGIGPDEALRRLKEGNARFVAETPRRQNHSAKRLATSQHGQTPYATILSCADSRAPVELIFDEGVGDLFVIRVAGNVARTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKAHC

SEQ ID NO: 961 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcgtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 962 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCSDSRAPVELIFDEGVGDLFVIRVAGNVARTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 963 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtcgtaacttatctgcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcgtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 964 - protein, 223 aa, Artificial Sequence
  Engineered variant of carbonic anhydrase from D. vulgaris
MGSMGPGIGPDEALRRLKEGNARFVAETPRRRNLSAKRLATSQHGQTPYATILSCSDSRAPVELIFDEGVGDLFVIRVAGNVARTDEVGTAEYGADHLNVPLLVVMGHTQCGAVTAVVQGAEVHGSIPMLVAPIVPAVTAVEKSNPKHDRAALVPKVIEANVWQAIDDTMRQSPIIRARVAAGKLKVVGAIYHIDDGKVEWLGEHPMQARLLNYTSGPAKCHC

SEQ ID NO: 965 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtaggcggatcaatcccgatgttagtggcgccgattgtgcctgcagtacaggctgtagagaagagctgcccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaagctcaccgctaa

SEQ ID NO: 966 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVGGSIPMLVAPIVPAVQAVEKSCPKHDRAALVPLVIEANVWQAIDDTMRQSPIIRARVAAGKLKVVGAIYHIDDGKVEWLGEHPMQARLLQYTSGPAKAHR

SEQ ID NO: 967 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 968 - protein, 223 aa, Artificial Sequence
  Engineered variant of carbonic anhydrase from D. vulgaris
MRSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSCPKHDRAALVPKVIEANVWQAIDDTMRQSPIIRARVAAGKLKVVGAIYHIDDGKVEWLGEHPMQARLLNYTSGPAKAHR

SEQ ID NO: 969 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaccaccttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagctgcccgaaaaccgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 970 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGADHLNVPLLVVMGHTQCGAVTAVVQGAEVHGSIPMLVAPIVPAVTAVEKSCPKTDRAALVPLVIEANVWQAIDDTMRQSPIIRARVAAGKLKVVGAIYHIDDGKVEWLGEHPMQARLLNYTSGPAKAHR

SEQ ID NO: 971 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtcagaacttatctgcaaagcgcctggcgacgtctcaacatggacaaacgccgtatgccacgatcctttcttgtgcggattcaagagcgccagtagagctgatcttcgacgagggcgtaggcgatctattcgttatccgtgttgcgggcaatgtagcggcgacagatgaagtgggaacagcggagtacggagccgaacaccttaacgttcctctgcttgtagtgatgggccatacacaatgcggtgctgtaactgcagtggtacaaggagcggaggtaggcggatcaatcccgatgttagtggcgccgattgtgcctgcagtaacagctgtactgaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaagctcaccgctaa

SEQ ID NO: 972 - protein, 223 aa, Artificial Sequence
  Engineered variant of carbonic anhydrase from D. vulgaris
MGSTGPGIGPDEALRRLKEGNARFVAETPRRQNLSAKRLATSQHGQTPYATILSCADSRAPVELIFDEGVGDLFVIRVAGNVAATDEVGTAEYGAEHLNVPLLVVMGHTQCGAVTAVVQGAEVGGSIPMLVAPIVPAVTAVLKSCPKHDRAALVPKVIEANVWQAIDDTMRQSPIIRARVAAGKLKVVGAIYHIDDGKVEWLGEHPMQARLLNYTSGPAKAHR

SEQ ID NO: 973 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgaacacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtacatgctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 974 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGIGDLFVIRVAGNVANTDEVGTAEYGADHLNVPLLVVMGHTQCGAVTAVVQGAEVHGSIPMLLAPIVPAVHAVEKSNPKHDRAALVPKAIEANVWQAIDDTMRQSPIIRARVAAGKLKVVGAIYHIDDGKVEWLGEHPMQARLLNYTSGPAKCHR

SEQ ID NO: 975 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggccgaaaaacttagcggcaaagcgcctggcgacgtctcaacatggacaacgtccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 976 - protein, 223 aa, Artificial Sequence
  Engineered variant of carbonic anhydrase from D. vulgaris
MGSTGPGIGPDEALRRLKEGNARFVAETPRPKNLAAKRLATSQHGQRPYATILSCSDSRAPVELIFDEGVGDLFVIRVAGNVANTDEVGTAEYGADFLNVPLLVVMGHTQCGAVTAVVQGAEVHGSIPMLVAPIVPAVTAVEKSNPKHDRAALVPLVIEANVWQAIDDTMRQSPIIRARVAAGKLKVVGAIYHIDDGKVEWLGEHPMQARLLNYTSGPAKCHR

SEQ ID NO: 977 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaaaacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtacaggctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaatgccaccgctaa

SEQ ID NO: 978 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGVGDLFVIRVAGNVAKTDEVGTAEYGADHLNVPLLVVMGHTQCGAVTAVVQGAEVHGSIPMLLAPIVPAVQAVEKSCPKHDRAALVPKVIEANVWQAIDDTMRQSPIIRARVAAGKLKVVGAIYHIDDGKVEWLGEHPMQARLLQYTSGPAKCHR

SEQ ID NO: 979 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggccgaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaatttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 980 - protein, 223 aa, Artificial Sequence
  Engineered variant of carbonic anhydrase from D. vulgaris
MRSTGPGIGPDEALRRLKEGNARFVAETPRPKNLAAKRLATSQHGQTPYATILSCSDSRAPVELIFDEGVGDLFVIRVAGNVANTDEVGTAEYGAEFLNVPLLVVMGHTQCGAVTAVVQGAEVHGSIPMLVAPIVPAVTAVEKSNPKTDRAALVPKVIEANVWQAIDDTMRQSPIIRARVAAGKLKVVGAIYHIDDGKVEWLGEHPMQARLLNYTSGPAKCHR

SEQ ID NO: 981 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaatttcttaacgttcctctgcttgtagtgatgggccatacacaatgcggtgctgtaactgcagtggtacaaggagcggaggtacatggatcaatcccgatgttagtggcgccgattgtgcctgcatttacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 982 - protein, 223 aa, Artificial Sequence
  Engineered variant of carbonic anhydrase from D. vulgaris
MRSTGPGIGPDEALRRLKEGNARFVAETPRRKNLAAKRLATSQHGQTPYATILSCSDSRAPVELIFDEGVGDLFVIRVAGNVANTDEVGTAEYGAEFLNVPLLVVMGHTQCGAVTAVVQGAEVHGSIPMLVAPIVPAFTAVEKSNPKHDRAALVPLVIEANVWQAIDDTMRQSPIIRARVAAGKLKVVGAIYHIDDGKVEWLGEHPMQARLLNYTSGPAKCHR

SEQ ID NO: 983 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggccgaaaaacttagcggcaaagcgcctggcgacgtctcaacatggacaacgtccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgactttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaaaccgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 984 - protein, 223 aa, Artificial Sequence
  Engineered variant of carbonic anhydrase from D. vulgaris
MRSTGPGIGPDEALRRLKEGNARFVAETPRPKNLAAKRLATSQHGQRPYATILSCSDSRAPVELIFDEGVGDLFVIRVAGNVANTDEVGTAEYGADFLNVPLLVVMGHTQCGAVTAVVQGAEVHGSIPMLVAPIVPAVTAVEKSNPKTDRAALVPLVIEANVWQAIDDTMRQSPIIRARVAAGKLKVVGAIYHIDDGKVEWLGEHPMQARLLNYTSGPAKCHR

SEQ ID NO: 985 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtacaggctgtagagaagagctgcccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 986 - protein, 223 aa, Artificial Sequence
  Engineered variant of carbonic anhydrase from D. vulgaris
MGSTGPGIGPDEALRRLKEGNARFVAETPRRKNHAAKRLATSQHGQTPYATILSCSDSRAPVELIFDEGVGDLFVIRVAGNVANTDEVGTAEYGVDHLNVPLLVVMGHTQCGAVTAVVQGAEVGGSIPMLLAPIVPAVQAVEKSCPKHDRAALVPKAIEANVWQAIDDTMRQSPIIRARVAAGKLKVVGAIYHIDDGKVEWLGEHPMQARLLEYTSGPAKCHR

SEQ ID NO: 987 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagtggaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 988 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGVGDLFVIRVAGNVANTDEVGTAEYGVDHLNVPLLVVMGHTQCGAVTAVVQGAEVHGSIPMLLAPIVPAVTAVEKSCPKHDRAALVPKVIEANVWQAIDDTMRQSPIIRARVAAGKLKVVGAIYHIDDGKVEWLGEHPMQARLLNYTSGPAKCHC

SEQ ID NO: 989 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccactgctaa

SEQ ID NO: 990 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGVGDLFVIRVAGNVANTDEVGTAEYGVDHLNVPLLVVMGHTQCGAVTAVVQGAEVGGSIPMLLAPIVPAVTAVEKSCPKHDRAALVPKVIEANVWQAIDDTMRQSPIIRARVAAGKLKVVGAIYHIDDGKVEWLGEHPMQARLLEYTSGPAKCHC

SEQ ID NO: 991 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaatttcttaacgttcctctgcttgtagtgatgggccatacacaatgcggtgctgtaactgcagtggtacaaggacaggaggtacatggatcaatcccgatgttagtggcgccgattgtgcctgcagtaacagctgtagagaagagcaacccgaaaaccgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 992 - protein, 223 aa, Artificial Sequence
  Engineered variant of carbonic anhydrase from D. vulgaris
MRSTGPGIGPDEALRRLKEGNARFVAETPRRKNLAAKRLATSQHGQTPYATILSCSDSRAPVELIFDEGVGDLFVIRVAGNVANTDEVGTAEYGAEFLNVPLLVVMGHTQCGAVTAVVQGQEVHGSIPMLVAPIVPAVTAVEKSNPKTDRAALVPLVIEANVWQAIDDTMRQSPIIRARVAAGKLKVVGAIYHIDDGKVEWLGEHPMQARLLNYTSGPAKCHR

SEQ ID NO: 993 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgaaaacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 994 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGIGDLFVIRVAGNVAKTDEVGTAEYGVDHLNVPLLVVMGHTQCGAVTAVVQGAEVGGSIPMLLAPIVPAVTAVEKSCPKHDRAALVPKVIEANVWQAIDDTMRQSPIIRARVAAGKLKVVGAIYHIDDGKVEWLGEHPMQARLLNYTSGPAKCHR

SEQ ID NO: 995 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggccgaaaaacttagcggcacgtcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaatttcttaacgttcctctgcttgtagtgatgggccatacacaatgcggtgctgtaactgcagtggtacaaggagcggaggtacatggatcaatcccgatgttagtggcgccgattgtgcctgcatttacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 996 - protein, 223 aa, Artificial Sequence
  Engineered variant of carbonic anhydrase from D. vulgaris
MGSTGPGIGPDEALRRLKEGNARFVAETPRPKNLAARRLATSQHGQTPYATILSCSDSRAPVELIFDEGVGDLFVIRVAGNVANTDEVGTAEYGAEFLNVPLLVVMGHTQCGAVTAVVQGAEVHGSIPMLVAPIVPAFTAVEKSNPKHDRAALVPLVIEANVWQAIDDTMRQSPIIRARVAAGKLKVVGAIYHIDDGKVEWLGEHPMQARLLNYTSGPAKCHR

SEQ ID NO: 997 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgctgctgctaa

SEQ ID NO: 998 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGVGDLFVIRVAGNVANTDEVGTAEYGADHLNVPLLVVMGHTQCGAVTAVVQGAEVGGSIPMLLAPIVPAVTAVEKSCPKHDRAALVPKVIEANVWQAIDDTMRQSPIIRARVAAGKLKVVGAIYHIDDGKVEWLGEHPMQARLLNYTSGPAKCCC

SEQ ID NO: 999 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1000 - protein, 223 aa, Artificial Sequence
  Engineered variant of carbonic anhydrase from D. vulgaris
MGSMGPGIGPDEALRRLKEGNARFVAETPRRKNHAAKRLATSQHGQTPYATILSCSDSRAPVELIFDEGVGDLFVIRVAGNVANTDEVGTAEYGVDHLNVPLLVVMGHTQCGAVTAVVQGAEVGGSIPMLLAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 1001 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggccgaaaaacttagcggcatgccgcctgctgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaatttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1002 - protein, 223 aa, Artificial Sequence
  Engineered variant of carbonic anhydrase from D. vulgaris
MRSTGPGIGPDEALRRLKEGNARFVAETPRPKNLAACRLLTSQHGQTPYATILSCSDSRAPVELIFDEGVGDLFVIRVAGNVANTDEVGTAEYGAEFLNVPLLVVMGHTQCGAVTAVVQGAEVHGSIPMLVAPIVPAVTAVEKSNPKHDRAALVPLVIEANVWQAIDDTMRQSPIIRARVAAGKLKVVGAIYHIDDGKVEWLGEHPMQARLLNYTSGPAKCHR

SEQ ID NO: 1003 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggccgaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaatttcttaacgttcctctgcttgtagtgatgggccatacacaatgcggtgctgtaactgcagtggtacaaggagcggaggtacatggatcaatcccgatgttagtggcgccgattgtgcctgcagtaacagctgtagagaagagcaacccgaaacacgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1004 - protein, 223 aa, Artificial Sequence
  Engineered variant of carbonic anhydrase from D. vulgaris
MGSTGPGIGPDEALRRLKEGNARFVAETPRPKNLAAKRLATSQHGQTPYATILSCSDSRAPVELIFDEGVGDLFVIRVAGNVANTDEVGTAEYGAEFLNVPLLVVMGHTQCGAVTAVVQGAEVHGSIPMLVAPIVPAVTAVEKSNPKHDRAALVPLVIEANVWQAIDDTMRQSPIIRARVAAGKLKVVGAIYHIDDGKVEWLGEHPMQARLLNYTSGPAKCHR

SEQ ID NO: 1005 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaacaccttaacgttcctctgcttgtagtgatgggccatacacaatgcggtgctgtaactgcagtggtacaaggacaggaggtacatggatcaatcccgatgttagtggcgccgattgtgcctgcatttacagctgtagagaagagcaacccgaaaaccgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1006 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGVGDLFVIRVAGNVANTDEVGTAEYGAEHLNVPLLVVMGHTQCGAVTAVVQGQEVHGSIPMLVAPIVPAFTAVEKSNPKTDRAALVPLVIEANVWQAIDDTMRQSPIIRARVAAGKLKVVGAIYHIDDGKVEWLGEHPMQARLLNYTSGPAKCHR

SEQ ID NO: 1007 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcgtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtacaggctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgctgctgctaa

SEQ ID NO: 1008 - protein, 223 aa, Artificial Sequence
  Engineered variant of carbonic anhydrase from D. vulgaris
MGSTGPGIGPDEALRRLKEGNARFVAETPRRKNHAAKRLATSQHGQTPYATILSCSDSRAPVELIFDEGIGDLFVIRVAGNVARTDEVGTAEYGADHLNVPLLVVMGHTQCGAVTAVVQGAEVHGSIPMLLAPIVPAVQAVEKSCPKHDRAALVPKVIEANVWQAIDDTMRQSPIIRARVAAGKLKVVGAIYHIDDGKVEWLGEHPMQARLLNYTSGPAKCCC

SEQ ID NO: 1009 - DNA, 672 bp, Artificial Sequence
  Engineered variant of carbonic anhydrase from D. vulgaris
atgcgtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaacacagatgaagtgggaacagcggagtacggagccgaatttcttaacgttcctctgcttgtagtgatgggccatacacaatgcggtgctgtaactgcagtggtacaaggaaaagaggtacatggatcaatcccgatgttagtggcgccgattgtgcctgcatggacagctgtagagaagagcaacccgaaaaccgaccgcgcggctttagtgccgctggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1010 - protein, 223 aa, Artificial Sequence
  Engineered variant of carbonic anhydrase from D. vulgaris
MRSTGPGIGPDEALRRLKEGNARFVAETPRRKNLAAKRLATSQHGQTPYATILSCSDSRAPVELIFDEGVGDLFVIRVAGNVANTDEVGTAEYGAEFLNVPLLVVMGHTQCGAVTAVVQGKEVHGSIPMLVAPIVPAWTAVEKSNPKTDRAALVPLVIEANVWQAIDDTMRQSPIIRARVAAGKLKVVGAIYHIDDGKVEWLGEHPMQARLLNYTSGPAKCHR

SEQ ID NO: 1011 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcgtacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1012 - protein, 223 aa, Artificial Sequence
  Engineered variant of carbonic anhydrase from D. vulgaris
MGSTGPGIGPDEALRRLKEGNARFVAETPRRKNHAAKRLATSQHGQTPYATILSCSDSRAPVELIFDEGVGDLFVIRVAGNVARTDEVGTAEYGADHLNVPLLVVMGHTQCGAVTAVVQGAEVHGSIPMLLAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 1013 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttactggcgccgattgtgcctgcagtacaggctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaatgccaccgctaa

SEQ ID NO: 1014 - protein, 223 aa, Artificial Sequence
  Engineered variant of carbonic anhydrase from D. vulgaris
MGSTGPGIGPDEALRRLKEGNARFVAETPRRKNHAAKRLATSQHGQTPYATILSCSDSRAPVELIFDEGVGDLFVIRVAGNVAQTDEVGTAEYGADHLNVPLLVVMGHTQCGAVTAVVQGAEVGGSIPMLLAPIVPAVQAVEKSCPKHDRAALVPKVIEANVWQAIDDTMRQSPIIRARVAAGKLKVVGAIYHIDDGKVEWLGEHPMQARLLQYTSGPAKCHR

SEQ ID NO: 1015 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1016 - protein, 223 aa, Artificial Sequence
  Engineered variant of carbonic anhydrase from D. vulgaris
MGSMGPGIGPDEALRRLKEGNARFVAETPRRKNHAAKRLATSQHGQTPYATILSCSDSRAPVELIFDEGIGDLFVIRVAGNVAQTDEVGTAEYGVDHLNVPLLVVMGHTQCGAVTAVVQGAEVGGSIPMLLAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 1017 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaaaacagatgaagtgggaacagcggagtacggagtggaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagctgcccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaatgccaccgctaa

SEQ ID NO: 1018 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGVGDLFVIRVAGNVAKTDEVGTAEYGVDHLNVPLLVVMGHTQCGAVTAVVQGAEVHGSIPMLLAPIVPAVTAVEKSCPKHDRAALVPKAIEANVWQAIDDTMRQSPIIRARVAAGKLKVVGAIYHIDDGKVEWLGEHPMQARLLQYTSGPAKCHR

SEQ ID NO: 1019 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttactggcgccgattgtgcctgcagtacatgctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 1020 - protein, 223 aa, Artificial Sequence
  Engineered variant of carbonic anhydrase from D. vulgaris
MGSTGPGIGPDEALRRLKEGNARFVAETPRRKNHAAKRLATSQHGQTPYATILSCSDSRAPVELIFDEGVGDLFVIRVAGNVAQTDEVGTAEYGADHLNVPLLVVMGHTQCGAVTAVVQGAEVGGSIPMLLAPIVPAVHAVEKSNPKHDRAALVPKVIEANVWQAIDDTMRQSPIIRARVAAGKLKVVGAIYHIDDGKVEWLGEHPMQARLLEYTSGPAKCHR

SEQ ID NO: 1021 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaaaacagatgaagtgggaacagcggagtacggagtggaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1022 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGVGDLFVIRVAGNVAKTDEVGTAEYGVDHLNVPLLVVMGHTQCGAVTAVVQGAEVHGSIPMLLAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 1023 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 1024 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGVGDLFVIRVAGNVAQTDEVGTAEYGVDHLNVPLLVVMGHTQCGAVTAVVQGAEVHGSIPMLLAPIVPAVTAVEKSNPKHDRAALVPKVIEANVWQAIDDTMRQSPIIRARVAAGKLKVVGAIYHIDDGKVEWLGEHPMQARLLEYTSGPAKCHR

SEQ ID NO: 1025 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtacaggctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1026 - protein, 223 aa, Artificial Sequence
  Engineered variant of carbonic anhydrase from D. vulgaris
MGSMGPGIGPDEALRRLKEGNARFVAETPRRKNHAAKRLATSQHGQTPYATILSCSDSRAPVELIFDEGIGDLFVIRVAGNVAQTDEVGTAEYGVDHLNVPLLVVMGHTQCGAVTAVVQGAEVGGSIPMLLAPIVPAVQAVEKSCPKHDRAALVPKVIEANVWQAIDDTMRQSPIIRARVAAGKLKVVGAIYHIDDGKVEWLGEHPMQARLLNYTSGPAKCHR

SEQ ID NO: 1027 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtacatggatcaatcccgatgttactggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgctgccgctaa

SEQ ID NO: 1028 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGVGDLFVIRVAGNVAQTDEVGTAEYGVDHLNVPLLVVMGHTQCGAVTAVVQGAEVHGSIPMLLAPIVPAVTAVEKSNPKHDRAALVPKAIEANVWQAIDDTMRQSPIIRARVAAGKLKVVGAIYHIDDGKVEWLGEHPMQARLLNYTSGPAKCCR

SEQ ID NO: 1029 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaaaacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtacaggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaatgctgctgctaa

SEQ ID NO: 1030 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGVGDLFVIRVAGNVAKTDEVGTAEYGVDHLNVPLLVVMGHTQCGAVTAVVQGAEVGGSIPMLLAPIVPAVQAVEKSNPKHDRAALVPKVIEANVWQAIDDTMRQSPIIRARVAAGKLKVVGAIYHIDDGKVEWLGEHPMQARLLQYTSGPAKCCC

SEQ ID NO: 1031 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1032 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGVGDLFVIRVAGNVAQTDEVGTAEYGVDHLNVPLLVVMGHTQCGAVTAVVQGAEVGGSIPMLLAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 1033 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtacatggatcaatcccgatgttactggcgccgattgtgcctgcagtacaggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1034 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGIGDLFVIRVAGNVAQTDEVGTAEYGVDHLNVPLLVVMGHTQCGAVTAVVQGAEVHGSIPMLLAPIVPAVQAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 1035 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1036 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGVGDLFVIRVAGNVAQTDEVGTAEYGADHLNVPLLVVMGHTQCGAVTAVVQGAEVGGSIPMLLAPIVPAVTAVEKSNPKHDRAALVPKVIEANVWQAIDDTMRQSPIIRARVAAGKLKVVGAIYHIDDGKVEWLGEHPMQARLLNYTSGPAKCHR

SEQ ID NO: 1037 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcgtacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgctgctgctaa

SEQ ID NO: 1038 - protein, 223 aa, Artificial Sequence
  Engineered variant of carbonic anhydrase from D. vulgaris
MGSMGPGIGPDEALRRLKEGNARFVAETPRRKNHAAKRLATSQHGQTPYATILSCSDSRAPVELIFDEGIGDLFVIRVAGNVARTDEVGTAEYGVDHLNVPLLVVMGHTQCGAVTAVVQGAEVGGSIPMLLAPIVPAVTAVEKSNPKHDRAALVPKAIEANVWQAIDDTMRQSPIIRARVAAGKLKVVGAIYHIDDGKVEWLGEHPMQARLLEYTSGPAKCCC

SEQ ID NO: 1039 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtacatgctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaatgccactgctaa

SEQ ID NO: 1040 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGIGDLFVIRVAGNVAQTDEVGTAEYGADHLNVPLLVVMGHTQCGAVTAVVQGAEVHGSIPMLLAPIVPAVHAVEKSNPKHDRAALVPKVIEANVWQAIDDTMRQSPIIRARVAAGKLKVVGAIYHIDDGKVEWLGEHPMQARLLQYTSGPAKCHC

SEQ ID NO: 1041 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgaaaacagatgaagtgggaacagcggagtacggagccgaccaccttaacgttcctctgcttgtagtgatgggccatacacaatgcggtgctgtaactgcagtggtacaaggagcggaggtacatggatcaatcccgatgttactggcgccgattgtgcctgcagtacaggctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgctgctgctaa

SEQ ID NO: 1042 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGIGDLFVIRVAGNVAKTDEVGTAEYGADHLNVPLLVVMGHTQCGAVTAVVQGAEVHGSIPMLLAPIVPAVQAVEKSNPKHDRAALVPKVIEANVWQAIDDTMRQSPIIRARVAAGKLKVVGAIYHIDDGKVEWLGEHPMQARLLNYTSGPAKCCC

SEQ ID NO: 1043 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagcaacccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 1044 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGVGDLFVIRVAGNVAQTDEVGTAEYGVDHLNVPLLVVMGHTQCGAVTAVVQGAEVGGSIPMLLAPIVPAVTAVEKSNPKHDRAALVPKVIEANVWQAIDDTMRQSPIIRARVAAGKLKVVGAIYHIDDGKVEWLGEHPMQARLLEYTSGPAKCHR

SEQ ID NO: 1045 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagccgaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagctgcccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 1046 - protein, 223 aa, Artificial Sequence
  Engineered variant of carbonic anhydrase from D. vulgaris
MGSMGPGIGPDEALRRLKEGNARFVAETPRRKNHAAKRLATSQHGQTPYATILSCSDSRAPVELIFDEGVGDLFVIRVAGNVAQTDEVGTAEYGADHLNVPLLVVMGHTQCGAVTAVVQGAEVGGSIPMLLAPIVPAVTAVEKSCPKHDRAALVPKAIEANVWQAIDDTMRQSPIIRARVAAGKLKVVGAIYHIDDGKVEWLGEHPMQARLLEYTSGPAKCHR

SEQ ID NO: 1047 - DNA, 672 bp, Artificial Sequence
  Engineered variant of carbonic anhydrase from D. vulgaris
atgggtagcacgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtacatggatcaatcccgatgttactggcgccgattgtgcctgcagtacatgctgtagagaagagctgcccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgctgctgctaa

SEQ ID NO: 1048 - protein, 223 aa, Artificial Sequence
  Engineered variant of carbonic anhydrase from D. vulgaris
MGSTGPGIGPDEALRRLKEGNARFVAETPRRKNLAAKRLATSQHGQTPYATILSCSDSRAPVELIFDEGVGDLFVIRVAGNVAQTDEVGTAEYGVDHLNVPLLVVMGHTQCGAVTAVVQGAEVHGSIPMLLAPIVPAVHAVEKSCPKHDRAALVPKAIEANVWQAIDDTMRQSPIIRARVAAGKLKVVGAIYHIDDGKVEWLGEHPMQARLLNYTSGPAKCCC

SEQ ID NO: 1049 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1050 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGVGDLFVIRVAGNVAQTDEVGTAEYGVDHLNVPLLVVMGHTQCGAVTAVVQGAEVGGSIPMLLAPIVPAVTAVEKSNPKHDRAALVPKAIEANVWQAIDDTMRQSPIIRARVAAGKLKVVGAIYHIDDGKVEWLGEHPMQARLLNYTSGPAKCHR

SEQ ID NO: 1051 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaaccatgcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaaaacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagctgcccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgctgctgctaa

SEQ ID NO: 1052 - protein, 223 aa, Artificial Sequence
  Engineered variant of carbonic anhydrase from D. vulgaris
MGSMGPGIGPDEALRRLKEGNARFVAETPRRKNHAAKRLATSQHGQTPYATILSCSDSRAPVELIFDEGVGDLFVIRVAGNVAKTDEVGTAEYGVDHLNVPLLVVMGHTQCGAVTAVVQGAEVGGSIPMLLAPIVPAVTAVEKSCPKHDRAALVPKVIEANVWQAIDDTMRQSPIIRARVAAGKLKVVGAIYHIDDGKVEWLGEHPMQARLLNYTSGPAKCCC

SEQ ID NO: 1053 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcgtaggcgatctattcgttatccgtgttgcgggcaatgtagcgaaaacagatgaagtgggaacagcggagtacggagtggaccaccttaacgttcctctgcttgtagtgatgggccatacacaatgcggtgctgtaactgcagtggtacaaggagcggaggtaggcggatcaatcccgatgttactggcgccgattgtgcctgcagtaacagctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaatgctgctgctaa

SEQ ID NO: 1054 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGVGDLFVIRVAGNVAKTDEVGTAEYGVDHLNVPLLVVMGHTQCGAVTAVVQGAEVGGSIPMLLAPIVPAVTAVEKSNPKHDRAALVPKAIEANVWQAIDDTMRQSPIIRARVAAGKLKVVGAIYHIDDGKVEWLGEHPMQARLLQYTSGPAKCCC

SEQ ID NO: 1055 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtacatggatcaatcccgatgttactggcgccgattgtgcctgcagtacaggctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1056 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGIGDLFVIRVAGNVAQTDEVGTAEYGVDHLNVPLLVVMGHTQCGAVTAVVQGAEVHGSIPMLLAPIVPAVQAVEKSNPKHDRAALVPKAIEANVWQAIDDTMRQSPIIRARVAAGKLKVVGAIYHIDDGKVEWLGEHPMQARLLNYTSGPAKCHR

SEQ ID NO: 1057 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1058 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVDHLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVEWLGEHPMQARLLEYTSGPTKAHR

SEQ ID NO: 1059 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcgtaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1060 - protein, 223 aa, Artificial Sequence
  Engineered variant of carbonic anhydrase from D. vulgaris
MGSTGPGIGPDEALQRLKEGNARFVAETPRPRNLSARRLLTSQHGQTPYATILSCSDSRAPVELIFDAGVGDLFVIRVAGNVAQTDEVGTAEYGVDHLNVPLLVVMGHTQCGAVTAVVMRAEVRGSIPMLVAPIVPAVMAVEKSFPKHDRAALVPKVIEANVWQAIDDTMRQSPIIRARVAAGKLKVVGAIYHIDDGKVRWLGEHPMQARLLEYTSGPTKAHR

SEQ ID NO: 1061 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcgtaacttatctgcacgtcgcctgctgacgtctcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaatgctgccgctaa

SEQ ID NO: 1062 - protein, 223 aa, Artificial Sequence
  Engineered variant of carbonic anhydrase from D. vulgaris
MGSTGPGIGPDEALQRLKEGNARFVAETPRPRNLSARRLLTSQHGQTPYATILSCSDSRCPVELIFDAGVGDLFVIRVAGNVAQTDEVGTAEYGVDFLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVEWLGEHPMQARLLEYTSGPTKCCR

SEQ ID NO: 1063 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcgtaacttatctgcacgtcgcctgctgacgtctatgcatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1064 - protein, 223 aa, Artificial Sequence
  Engineered variant of carbonic anhydrase from D. vulgaris
MGSTGPGIGPDEALQRLKEGNARFVAETPRRRNLSARRLLTSMHGQTPYATILSCSDSRAPVELIFDAGVGDLFVIRVAGNVAQTDEVGTAEYGVDFLNVPLLVVMGHTQCGAVTAVVMRAEVRGSIPMLVAPIVPAVMAVEKSFPKTDRAALVPKAIEANVWQAIDDTFRQSPIIRARVAAGKLKVVGAIYHIDDGKVRWLGEHPMQARLLEYTSGPTKAHR

SEQ ID NO: 1065 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaatgctgccgctaa

SEQ ID NO: 1066 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRCPVELIFDAGVGDLFVIRVAGNVAQTDEVGTAEYGVDHLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVEWLGEHPMQARLLEYTSGPTKCCR

SEQ ID NO: 1067 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcgtaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1068 - protein, 223 aa, Artificial Sequence
  Engineered variant of carbonic anhydrase from D. vulgaris
MGSTGPGIGPDEALQRLKEGNARFVAETPRRRNLSARRLLTSQHGQTPYATILSCSDSRAPVELIFDAGVGDLFVIRVAGNVAQTDEVGTAEYGVDHLNVPLLVVMGHTQCGAVTAVVMRAEVRGSIPMLVAPIVPAVMAVEKSWPKHDRAALVPKVIEANVWQAIDDTMRQSPIIRARVAAGKLKVVGAIYHIDDGKVRWLGEHPMQARLLEYTSGPTKAHR

SEQ ID NO: 1069 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacggcgatgcatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaaaccgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1070 - protein, 223 aa, Artificial Sequence
  Engineered variant of carbonic anhydrase from D. vulgaris
MGSTGPGIGPDEALQRLKEGNARFVAETPRRQNLSARRLLTAMHGQTPYATILSCSDSRAPVELIFDAGVGDLFVIRVAGNVAQTDEVGTAEYGVDHLNVPLLVVMGHTQCGAVTAVVMRAEVHGSIPMLVAPIVPAVMAVEKSWPKTDRAALVPKAIEANVWQAIDDTMRQSPIIRARVAAGKLKVVGAIYHIDDGKVRWLGEHPMQARLLEYTSGPTKAHR

SEQ ID NO: 1071 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggcgtttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgtttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1072 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGVGDLFVIRVAGNVAQTDEVGTAEYGVAFLNVPLLVVMGHTQCGAVTAVVMRAEVHGSIPMLVAPIVPAVMAVEKLFPKHDRAALVPKVIEANVWQAIDDTMRQSPIIRARVAAGKLKVVGAIYHIDDGKVEWLGEHPMQARLLEYTSGPTKAHR

SEQ ID NO: 1073 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcgtaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1074 - protein, 223 aa, Artificial Sequence
  Engineered variant of carbonic anhydrase from D. vulgaris
MGSTGPGIGPDEALQRLKEGNARFVAETPRPRNLSARRLLTSQHGQTPYATILSCSDSRAPVELIFDAGVGDLFVIRVAGNVAQTDEVGTAEYGVDFLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVEWLGEHPMQARLLEYTSGPTKAHR

SEQ ID NO: 1075 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcgtaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaacaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctggccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1076 - protein, 223 aa, Artificial Sequence
  Engineered variant of carbonic anhydrase from D. vulgaris
MGSTGPGIGPDEALQRLKEGNARFVAETPRRRNLSARRLLTSQHGQTPYATILSCSDSRAPVELIFDAGIGDLFVIRVAGNVAQTDEVGTAEYGVEHLNVPLLVVMGHTQCGAVTAVVMRAEVRGSIPMLVAPIVPAVMAVEKSWPKHDRAALVPKAIEANVWQAIDDTMRQSPIIRARVAAGKLKVVGAIYHIDDGKVEWLGEHPMQARLLEYTSGPTKAHR

SEQ ID NO: 1077 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagtggcgtttcttaacgttcctctgcttgtagtgatgggccatacacaatgcggtgctgtaactgcagtggtaatgcgtgcggaggtatttggatcaatcccgatgttagtggcgccgattgtgcctgcagtaatggctgtagagaagagctggccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1078 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRCPVELIFDAGVGDLFVIRVAGNVAQTDEVGTAEYGVAFLNVPLLVVMGHTQCGAVTAVVMRAEVFGSIPMLVAPIVPAVMAVEKSWPKTDRAALVPKVIEANVWQAIDDTFRQSPIIRARVAAGKLKVVGAIYHIDDGKVEWLGEHPMQARLLEYTSGPTKAHR

SEQ ID NO: 1079 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtttccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1080 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVDHLNVPLLVVMGHTQCGAVTAVVMRAEVRGSIPMLVAPIVPAVMAVEKLFPKTDRAALVPKVIEANVWQAIDDTMRQSPIIRARVAAGKLKVVGAIYHIDDGKVRWLGEHPMQARLLEYTSGPTKAHR

SEQ ID NO: 1081 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtggccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1082 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVDHLNVPLLVVMGHTQCGAVTAVVMRAEVRGSIPMLVAPIVPAVMAVEKLWPKTDRAALVPKAIEANVWQAIDDTFRQSPIIRARVAAGKLKVVGAIYHIDDGKVRWLGEHPMQARLLEYTSGPTKAHR

SEQ ID NO: 1083 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcgtaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggcgtttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1084 - protein, 223 aa, Artificial Sequence
  Engineered variant of carbonic anhydrase from D. vulgaris
MGSTGPGIGPDEALQRLKEGNARFVAETPRPRNLSARRLLTSQHGQTPYATILSCSDSRAPVELIFDAGIGDLFVIRVAGNVAQTDEVGTAEYGVAFLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVEWLGEHPMQARLLEYTSGPTKAHR

SEQ ID NO: 1085 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1086 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVDHLNVPLLVVMGHTQCGAVTAVVMRAEVHGSIPMLVAPIVPAVMAVEKSWPKTDRAALVPKVIEANVWQAIDDTFRQSPIIRARVAAGKLKVVGAIYHIDDGKVEWLGEHPMQARLLEYTSGPTKAHR

SEQ ID NO: 1087 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcgtaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggcgtttcttaacgttcctctgcttgtagtgatgggccatacacaatgcggtgctgtaactgcagtggtaatgcgtgcggaggtatttggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagcttgccgctaa

SEQ ID NO: 1088 - protein, 223 aa, Artificial Sequence
  Engineered variant of carbonic anhydrase from D. vulgaris
MGSTGPGIGPDEALQRLKEGNARFVAETPRRRNLSARRLLTSQHGQTPYATILSCSDSRAPVELIFDAGVGDLFVIRVAGNVAQTDEVGTAEYGVAFLNVPLLVVMGHTQCGAVTAVVMRAEVFGSIPMLVAPIVPAVMAVEKSWPKHDRAALVPKVIEANVWQAIDDTFRQSPIIRARVAAGKLKVVGAIYHIDDGKVEWLGEHPMQARLLEYTSGPTKACR

SEQ ID NO: 1089 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtggccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1090 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGVGDLFVIRVAGNVAQTDEVGTAEYGVDHLNVPLLVVMGHTQCGAVTAVVMRAEVRGSIPMLVAPIVPAVMAVEKLWPKTDRAALVPKVIEANVWQAIDDTFRQSPIIRARVAAGKLKVVGAIYHIDDGKVEWLGEHPMQARLLEYTSGPTKAHR

SEQ ID NO: 1091 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtaaaaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaacaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgtggccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1092 - protein, 223 aa, Artificial Sequence
  Engineered variant of carbonic anhydrase from D. vulgaris
MGSTGPGIGPDEALQRLKEGNARFVAETPRRKNLSARRLLTSQHGQTPYATILSCSDSRAPVELIFDAGVGDLFVIRVAGNVAQTDEVGTAEYGVEHLNVPLLVVMGHTQCGAVTAVVMRAEVHGSIPMLVAPIVPAVMAVEKLWPKTDRAALVPKVIEANVWQAIDDTFRQSPIIRARVAAGKLKVVGAIYHIDDGKVEWLGEHPMQARLLEYTSGPTKAHR

SEQ ID NO: 1093 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagcttgccgctaa

SEQ ID NO: 1094 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRAPVELIFDAGVGDLFVIRVAGNVAQTDEVGTAEYGVDFLNVPLLVVMGHTQCGAVTAVVMRAEVHGSIPMLVAPIVPAVMAVEKSWPKHDRAALVPKVIEANVWQAIDDTFRQSPIIRARVAAGKLKVVGAIYHIDDGKVEWLGEHPMQARLLEYTSGPTKACR

SEQ ID NO: 1095 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaatgccaccgctaa

SEQ ID NO: 1096 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGIGDLFVIRVAGNVAQTDEVGTAEYGVDHLNVPLLVVMGHTQCGAVTAVVMRAEVHGSIPMLVAPIVPAVMAVEKSWPKTDRAALVPKVIEANVWQAIDDTFRQSPIIRARVAAGKLKVVGAIYHIDDGKVEWLGEHPMQARLLEYTSGPTKCHR

SEQ ID NO: 1097 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctttccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1098 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRAPVELIFDAGVGDLFVIRVAGNVAQTDEVGTAEYGVDHLNVPLLVVMGHTQCGAVTAVVMRAEVRGSIPMLVAPIVPAVMAVEKSFPKHDRAALVPKVIEANVWQAIDDTFRQSPIIRARVAAGKLKVVGAIYHIDDGKVRWLGEHPMQARLLEYTSGPTKAHR

SEQ ID NO: 1099 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcgtaacttatctgcacgtcgcctgctgacggcgatgcatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1100 - protein, 223 aa, Artificial Sequence
  Engineered variant of carbonic anhydrase from D. vulgaris
MGSTGPGIGPDEALQRLKEGNARFVAETPRPRNLSARRLLTAMHGQTPYATILSCSDSRAPVELIFDAGVGDLFVIRVAGNVAQTDEVGTAEYGVDHLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVEWLGEHPMQARLLEYTSGPTKAHR

SEQ ID NO: 1101 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctttccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1102 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKSFPKHDRAALVPKAIEANVWQAIDDTMRQSPIIRARVAAGKLKVVGAIYHIDDGKVEWLGEHPMQARLLEYTSGPTKAHR

SEQ ID NO: 1103 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggcgtttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctttccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1104 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRAPVELIFDAGVGDLFVIRVAGNVAQTDEVGTAEYGVAFLNVPLLVVMGHTQCGAVTAVVMRAEVHGSIPMLVAPIVPAVMAVEKSFPKTDRAALVPKVIEANVWQAIDDTFRQSPIIRARVAAGKLKVVGAIYHIDDGKVEWLGEHPMQARLLEYTSGPTKAHR

SEQ ID NO: 1105 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacggcgcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtggccgaaaaccgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1106 - protein, 223 aa, Artificial Sequence
  Engineered variant of carbonic anhydrase from D. vulgaris
MGSTGPGIGPDEALQRLKEGNARFVAETPRRQNLSARRLLTAQHGQTPYATILSCSDSRAPVELIFDAGVGDLFVIRVAGNVAQTDEVGTAEYGVDFLNVPLLVVMGHTQCGAVTAVVMRAEVRGSIPMLVAPIVPAVMAVEKLWPKTDRAALVPKVIEANVWQAIDDTMRQSPIIRARVAAGKLKVVGAIYHIDDGKVEWLGEHPMQARLLEYTSGPTKAHR

SEQ ID NO: 1107 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacggcgcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtggccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1108 - protein, 223 aa, Artificial Sequence
  Engineered variant of carbonic anhydrase from D. vulgaris
MGSTGPGIGPDEALQRLKEGNARFVAETPRRQNLSARRLLTAQHGQTPYATILSCSDSRAPVELIFDAGVGDLFVIRVAGNVAQTDEVGTAEYGVDHLNVPLLVVMGHTQCGAVTAVVMRAEVRGSIPMLVAPIVPAVMAVEKLWPKHDRAALVPKAIEANVWQAIDDTMRQSPIIRARVAAGKLKVVGAIYHIDDGKVEWLGEHPMQARLLEYTSGPTKAHR

SEQ ID NO: 1109 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggcgtttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaatgctgccgctaa

SEQ ID NO: 1110 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGIGDLFVIRVAGNVAQTDEVGTAEYGVAFLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVEWLGEHPMQARLLEYTSGPTKCCR

SEQ ID NO: 1111 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctttccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1112 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGIGDLFVIRVAGNVAQTDEVGTAEYGVDHLNVPLLVVMGHTQCGAVTAVVMRAEVHGSIPMLVAPIVPAVMAVEKSFPKHDRAALVPKAIEANVWQAIDDTMRQSPIIRARVAAGKLKVVGAIYHIDDGKVEWLGEHPMQARLLEYTSGPTKAHR

SEQ ID NO: 1113 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1114 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVDHLNVPLLVVMGHTQCGAVTAVVMRAEVHGSIPMLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1115 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgtttccgaaaaccgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1116 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRAPVELIFDAGIGDLFVIRVAGNVAQTDEVGTAEYGVDFLNVPLLVVMGHTQCGAVTAVVMRAEVHGSIPMLVAPIVPAVMAVEKLFPKTDRAALVPKAIEANVWQAIDDTMRQSPIIRARVAAGKLKVVGAIYHIDDGKVEWLGEHPMQARLLEYTSGPTKAHR

SEQ ID NO: 1117 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacggcgcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1118 - protein, 223 aa, Artificial Sequence
  Engineered variant of carbonic anhydrase from D. vulgaris
MGSTGPGIGPDEALQRLKEGNARFVAETPRPQNLSARRLLTAQHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1119 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagatgcccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagcttgccgctaa

SEQ ID NO: 1120 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRCPVELIFDAGVGDLFVIRVAGNVAQTDEVGTAEYGVDHLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVEWLGEHPMQARLLEYTSGPTKACR

SEQ ID NO: 1121 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgaaaaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaatttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1122 - protein, 223 aa, Artificial Sequence
  Engineered variant of carbonic anhydrase from D. vulgaris
MGSTGPGIGPDEALQRLKEGNARFVAETPRPKNLSARRLLTSQHGQTPYATILSCSDSRAPVELIFDAGVGDLFVIRVAGNVAQTDEVGTAEYGVEFLNVPLLVVMGHTQCGAVTAVVMRAEVHGSIPMLVAPIVPAVMAVEKSWPKHDRAALVPKVIEANVWQAIDDTMRQSPIIRARVAAGKLKVVGAIYHIDDGKVRWLGEHPMQARLLEYTSGPTKAHR

SEQ ID NO: 1123 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgaaaaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtggccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1124 - protein, 223 aa, Artificial Sequence
  Engineered variant of carbonic anhydrase from D. vulgaris
MGSTGPGIGPDEALQRLKEGNARFVAETPRPKNLSARRLLTSQHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKLWPKHDRAALVPKAIEANVWQAIDDTMRQSPIIRARVAAGKLKVVGAIYHIDDGKVEWLGEHPMQARLLEYTSGPTKAHR

SEQ ID NO: 1125 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggcgtttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1126 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVAFLNVPLLVVMGHTQCGAVTAVVMRAEVHGSIPMLVAPIVPAVMAVEKSWPKTDRAALVPKVIEANVWQAIDDTFRQSPIIRARVAAGKLKVVGAIYHIDDGKVEWLGEHPMQARLLEYTSGPTKAHR

SEQ ID NO: 1127 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1128 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRAPVELIFDAGIGDLFVIRVAGNVAQTDEVGTAEYGVDFLNVPLLVVMGHTQCGAVTAVVMRAEVRGSIPMLVAPIVPAVMAVEKSFPKTDRAALVPKAIEANVWQAIDDTFRQSPIIRARVAAGKLKVVGAIYHIDDGKVRWLGEHPMQARLLEYTSGPTKAHR

SEQ ID NO: 1129 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaacaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctggccgaaacacgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1130 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVEHLNVPLLVVMGHTQCGAVTAVVMRAEVRGSIPMLVAPIVPAVMAVEKSWPKHDRAALVPKAIEANVWQAIDDTFRQSPIIRARVAAGKLKVVGAIYHIDDGKVEWLGEHPMQARLLEYTSGPTKAHR

SEQ ID NO: 1131 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgtttccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1132 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVDHLNVPLLVVMGHTQCGAVTAVVMRAEVHGSIPMLVAPIVPAVMAVEKLFPKHDRAALVPKAIEANVWQAIDDTMRQSPIIRARVAAGKLKVVGAIYHIDDGKVEWLGEHPMQARLLEYTSGPTKAHR

SEQ ID NO: 1133 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaaaccgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagcttgccgctaa

SEQ ID NO: 1134 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGIGDLFVIRVAGNVAQTDEVGTAEYGVDFLNVPLLVVMGHTQCGAVTAVVMRAEVHGSIPMLVAPIVPAVMAVEKSWPKTDRAALVPKVIEANVWQAIDDTFRQSPIIRARVAAGKLKVVGAIYHIDDGKVEWLGEHPMQARLLEYTSGPTKACR

SEQ ID NO: 1135 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctatgcatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgtttccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1136 - protein, 223 aa, Artificial Sequence
  Engineered variant of carbonic anhydrase from D. vulgaris
MGSTGPGIGPDEALQRLKEGNARFVAETPRRQNLSARRLLTSMHGQTPYATILSCSDSRAPVELIFDAGVGDLFVIRVAGNVAQTDEVGTAEYGVDFLNVPLLVVMGHTQCGAVTAVVMRAEVHGSIPMLVAPIVPAVMAVEKLFPKHDRAALVPKAIEANVWQAIDDTMRQSPIIRARVAAGKLKVVGAIYHIDDGKVEWLGEHPMQARLLEYTSGPTKAHR

SEQ ID NO: 1137 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacggcgcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgtggccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1138 - protein, 223 aa, Artificial Sequence
  Engineered variant of carbonic anhydrase from D. vulgaris
MGSTGPGIGPDEALQRLKEGNARFVAETPRRQNLSARRLLTAQHGQTPYATILSCSDSRAPVELIFDAGVGDLFVIRVAGNVAQTDEVGTAEYGVDHLNVPLLVVMGHTQCGAVTAVVMRAEVHGSIPMLVAPIVPAVMAVEKLWPKTDRAALVPKAIEANVWQAIDDTFRQSPIIRARVAAGKLKVVGAIYHIDDGKVRWLGEHPMQARLLEYTSGPTKAHR

SEQ ID NO: 1139 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcgtaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1140 - protein, 223 aa, Artificial Sequence
  Engineered variant of carbonic anhydrase from D. vulgaris
MGSTGPGIGPDEALQRLKEGNARFVAETPRPRNLSARRLLTSQHGQTPYATILSCSDSRAPVELIFDAGVGDLFVIRVAGNVAQTDEVGTAEYGVDHLNVPLLVVMGHTQCGAVTAVVMRAEVRGSIPMLVAPIVPAVMAVEKLFPKTDRAALVPKAIEANVWQAIDDTFRQSPIIRARVAAGKLKVVGAIYHIDDGKVEWLGEHPMQARLLEYTSGPTKAHR

SEQ ID NO: 1141 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgaaaaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaacaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctttccgaaacacgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1142 - protein, 223 aa, Artificial Sequence
  Engineered variant of carbonic anhydrase from D. vulgaris
MGSTGPGIGPDEALQRLKEGNARFVAETPRPKNLSARRLLTSQHGQTPYATILSCSDSRAPVELIFDAGVGDLFVIRVAGNVAQTDEVGTAEYGVEHLNVPLLVVMGHTQCGAVTAVVMRAEVRGSIPMLVAPIVPAVMAVEKSFPKHDRAALVPKAIEANVWQAIDDTFRQSPIIRARVAAGKLKVVGAIYHIDDGKVEWLGEHPMQARLLEYTSGPTKAHR

SEQ ID NO: 1143 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacggcgcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgtttccgaaacacgaccgcgcggctttagtgccgaaggtgatcgaggcgaacgtgtggcaagcgatcgatgacacatttcgacaatctccaatcatcagagcacgagtagcagcaggcaagttaaaagtggtgggcgctatctaccatatcgacgacggcaaagtacgttggctgggcgaacatccaatgcaggctcgattactggaatacacatctggacctaccaaagctcaccgctaa

SEQ ID NO: 1144 - protein, 223 aa, Artificial Sequence
  Engineered variant of carbonic anhydrase from D. vulgaris
MGSTGPGIGPDEALQRLKEGNARFVAETPRRQNLSARRLLTAQHGQTPYATILSCSDSRAPVELIFDAGIGDLFVIRVAGNVAQTDEVGTAEYGVDHLNVPLLVVMGHTQCGAVTAVVMRAEVHGSIPMLVAPIVPAVMAVEKLFPKHDRAALVPKVIEANVWQAIDDTFRQSPIIRARVAAGKLKVVGAIYHIDDGKVRWLGEHPMQARLLEYTSGPTKAHR

SEQ ID NO: 1145 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctggccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1146 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVDFLNVPLLVVMGHTQCGAVTAVVMRAEVRGSIPMLVAPIVPAVMAVEKSWPKHDRAALVPKAIEANVWQAIDDTMRQSPIIRARVAAGKLKVVGAIYHIDDGKVEWLGEHPMQARLLEYTSGPTKAHR

SEQ ID NO: 1147 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcgtaacttatctgcacgtcgcctgctgacggcgatgcatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagctgtttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1148 - protein, 223 aa, Artificial Sequence
  Engineered variant of carbonic anhydrase from D. vulgaris
MGSTGPGIGPDEALQRLKEGNARFVAETPRPRNLSARRLLTAMHGQTPYATILSCSDSRAPVELIFDAGVGDLFVIRVAGNVAQTDEVGTAEYGVDHLNVPLLVVMGHTQCGAVTAVVMRAEVHGSIPMLVAPIVPAVMAVEKLFPKHDRAALVPKVIEANVWQAIDDTMRQSPIIRARVAAGKLKVVGAIYHIDDGKVEWLGEHPMQARLLEYTSGPTKAHR

SEQ ID NO: 1149 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgaaaaacttatctgcacgtcgcctgctgacgtctcaacatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctttccgaaacacgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1150 - protein, 223 aa, Artificial Sequence
  Engineered variant of carbonic anhydrase from D. vulgaris
MGSTGPGIGPDEALQRLKEGNARFVAETPRPKNLSARRLLTSQHGQTPYATILSCSDSRAPVELIFDAGIGDLFVIRVAGNVAQTDEVGTAEYGVDHLNVPLLVVMGHTQCGAVTAVVMRAEVHGSIPMLVAPIVPAVMAVEKSFPKHDRAALVPKAIEANVWQAIDDTFRQSPIIRARVAAGKLKVVGAIYHIDDGKVEWLGEHPMQARLLEYTSGPTKAHR

SEQ ID NO: 1151 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagagctttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1152 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1153 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtcgtcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaacaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagctgtttccgaaacacgaccgcgcggctttagtgccgaaggtgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1154 - protein, 223 aa, Artificial Sequence
  Engineered variant of carbonic anhydrase from D. vulgaris
MGSTGPGIGPDEALQRLKEGNARFVAETPRRQNLSARRLLTSQHGQTPYATILSCSDSRAPVELIFDAGVGDLFVIRVAGNVAQTDEVGTAEYGVEHLNVPLLVVMGHTQCGAVTAVVMRAEVRGSIPMLVAPIVPAVMAVEKLFPKHDRAALVPKVIEANVWQAIDDTMRQSPIIRARVAAGKLKVVGAIYHIDDGKVEWLGEHPMQARLLEYTSGPTKAHR

SEQ ID NO: 1155 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacggcgcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggcgtttcttaacgttcctctgcttgtagtgatgggccatacacaatgcggtgctgtaactgcagtggtaatgcgtgcggaggtacatggatcaatcccgatgttagtggcgccgattgtgcctgcagtaatggctgtagagaagagctggccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1156 - protein, 223 aa, Artificial Sequence
  Engineered variant of carbonic anhydrase from D. vulgaris
MGSTGPGIGPDEALQRLKEGNARFVAETPRPQNLSARRLLTAQHGQTPYATILSCSDSRAPVELIFDAGVGDLFVIRVAGNVAQTDEVGTAEYGVAFLNVPLLVVMGHTQCGAVTAVVMRAEVHGSIPMLVAPIVPAVMAVEKSWPKHDRAALVPKAIEANVWQAIDDTMRQSPIIRARVAAGKLKVVGAIYHIDDGKVEWLGEHPMQARLLEYTSGPTKAHR

SEQ ID NO: 1157 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctcaacatggacaaacgccgtatgccacgatcctttcttgtagtgattcaagagcgccagtagagctgatcttcgacgcgggcgtaggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtaatgcgtgcggaggtacgtggatcaatcccgatgttagtggcgccgattgtgcctgcagtaatggctgtagagaagagctggccgaaacacgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1158 - protein, 223 aa, Artificial Sequence
  Engineered variant of carbonic anhydrase from D. vulgaris
MGSTGPGIGPDEALQRLKEGNARFVAETPRPQNLSARRLLTSQHGQTPYATILSCSDSRAPVELIFDAGVGDLFVIRVAGNVAQTDEVGTAEYGVDHLNVPLLVVMGHTQCGAVTAVVMRAEVRGSIPMLVAPIVPAVMAVEKSWPKHDRAALVPKAIEANVWQAIDDTFRQSPIIRARVAAGKLKVVGAIYHIDDGKVEWLGEHPMQARLLEYTSGPTKAHR

SEQ ID NO: 1159 - DNA, 672 bp, Artificial Sequence
  Engineered variant of carbonic anhydrase from D. vulgaris
atgggtagcatgggaccgggaattggaccagacgaagctttaggccgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagtggaatttcttaacgttcctctgcttgtagtgatgggccatacacaatgcggtgctgtaactgcagtggtacaaggagcggaggtacatggatcaatcccgatgttactggcgccgattgtgcctgcagtacaggctgtagagaagagcaacccgaaacacgaccgcgcggctttagtgccgctggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1160 - protein, 223 aa, Artificial Sequence
  Engineered variant of carbonic anhydrase from D. vulgaris
MGSMGPGIGPDEALGRLKEGNARFVAETPRRKNLAAKRLATSQHGQTPYATILSCSDSRAPVELIFDEGIGDLFVIRVAGNVAQTDEVGTAEYGVEFLNVPLLVVMGHTQCGAVTAVVQGAEVHGSIPMLLAPIVPAVQAVEKSNPKHDRAALVPLAIEANVWQAIDDTMRQSPIIRARVAAGKLKVVGAIYHIDDGKVEWLGEHPMQARLLNYTSGPAKCHR

SEQ ID NO: 1161 - DNA, 672 bp, Artificial Sequence
  Engineered variant of carbonic anhydrase from D. vulgaris
atgggtagcatgggaccgggaattggaccagacgaagctttaggccgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtacaaggacaggaggtacatggatcaatcccgatgttactggcgccgattgtgcctgcagtacaggctgtagagaagagcaacccgaaaaccgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 1162 - protein, 223 aa, Artificial Sequence
  Engineered variant of carbonic anhydrase from D. vulgaris
MGSMGPGIGPDEALGRLKEGNARFVAETPRRKNLAAKRLATSQHGQTPYATILSCSDSRAPVELIFDEGIGDLFVIRVAGNVAQTDEVGTAEYGVDFLNVPLLVVMGHTQCGAVTAVVQGQEVHGSIPMLLAPIVPAVQAVEKSNPKTDRAALVPKAIEANVWQAIDDTMRQSPIIRARVAAGKLKVVGAIYHIDDGKVEWLGEHPMQARLLEYTSGPAKCHR

SEQ ID NO: 1163 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtacatggatcaatcccgatgttactggcgccgattgtgcctgcagtacaggctgtagagaagagcaacccgaaaaccgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccactgctaa

SEQ ID NO: 1164 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGIGDLFVIRVAGNVAQTDEVGTAEYGVDHLNVPLLVVMGHTQCGAVTAVVQGAEVHGSIPMLLAPIVPAVQAVEKSNPKTDRAALVPKAIEANVWQAIDDTMRQSPIIRARVAAGKLKVVGAIYHIDDGKVEWLGEHPMQARLLNYTSGPAKCHC

SEQ ID NO: 1165 - DNA, 672 bp, Artificial Sequence
  Engineered variant of carbonic anhydrase from D. vulgaris
atgcgtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcatacagatgaagtgggaacagcggagtacggagtggaatttcttaacgttcctctgcttgtagtgatgggccatacacaatgcggtgctgtaactgcagtggtacaaggaaaagaggtacatggatcaatcccgatgttactggcgccgattgtgcctgcagtacaggctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 1166 - protein, 223 aa, Artificial Sequence
  Engineered variant of carbonic anhydrase from D. vulgaris
MRSMGPGIGPDEALRRLKEGNARFVAETPRRKNLAAKRLATSQHGQTPYATILSCSDSRAPVELIFDEGIGDLFVIRVAGNVAHTDEVGTAEYGVEFLNVPLLVVMGHTQCGAVTAVVQGKEVHGSIPMLLAPIVPAVQAVEKSNPKHDRAALVPKAIEANVWQAIDDTMRQSPIIRARVAAGKLKVVGAIYHIDDGKVEWLGEHPMQARLLEYTSGPAKCHR

SEQ ID NO: 1167 - DNA, 672 bp, Artificial Sequence
  Engineered variant of carbonic anhydrase from D. vulgaris
atgggtagcatgggaccgggaattggaccagacgaagctttaggccgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagtggactttcttaacgttcctctgcttgtagtgatgggccatacacaatgcggtgctgtaactgcagtggtacaaggagcggaggtacatggatcaatcccgatgttactggcgccgattgtgcctgcagtacaggctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgaactacacatctggacctgctaaatgccaccgctaa

SEQ ID NO: 1168 - protein, 223 aa, Artificial Sequence
  Engineered variant of carbonic anhydrase from D. vulgaris
MGSMGPGIGPDEALGRLKEGNARFVAETPRRKNLAAKRLATSQHGQTPYATILSCSDSRAPVELIFDEGIGDLFVIRVAGNVAQTDEVGTAEYGVDFLNVPLLVVMGHTQCGAVTAVVQGAEVHGSIPMLLAPIVPAVQAVEKSNPKHDRAALVPKAIEANVWQAIDDTMRQSPIIRARVAAGKLKVVGAIYHIDDGKVEWLGEHPMQARLLNYTSGPAKCHR

SEQ ID NO: 1169 - DNA, 672 bp, Artificial Sequence
  Engineered variant of carbonic anhydrase from D. vulgaris
atgcgtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggaaaagaggtacatggatcaatcccgatgttactggcgccgattgtgcctgcagtacaggctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctgctaaatgccaccgctaa

SEQ ID NO: 1170 - protein, 223 aa, Artificial Sequence
  Engineered variant of carbonic anhydrase from D. vulgaris
MRSMGPGIGPDEALRRLKEGNARFVAETPRRKNLAAKRLATSQHGQTPYATILSCSDSRAPVELIFDEGIGDLFVIRVAGNVAQTDEVGTAEYGVDHLNVPLLVVMGHTQCGAVTAVVQGKEVHGSIPMLLAPIVPAVQAVEKSNPKHDRAALVPKAIEANVWQAIDDTMRQSPIIRARVAAGKLKVVGAIYHIDDGKVEWLGEHPMQARLLEYTSGPAKCHR

SEQ ID NO: 1171 - DNA, 672 bp, Artificial Sequence
  Engineered variant of carbonic anhydrase from D. vulgaris
atgggtagcatgggaccgggaattggaccagacgaagctttaaggcgtcttaaggaaggaaatgctagatttgtagccgaaacacctaggcgtaaaaacttagcggcaaagcgcctggcgacgtctcaacatggacaaacgccgtatgccacgatcctttcttgtagcgattcaagagcgccagtagagctgatcttcgacgagggcattggcgatctattcgttatccgtgttgcgggcaatgtagcgcagacagatgaagtgggaacagcggagtacggagtggaccaccttaacgttcctctgcttgtagtgatgggccatacacaatgcggtgctgtaactgcagtggtacaaggagcggaggtacatggatcaatcccgatgttactggcgccgattgtgcctgcagtacaggctgtagagaagagcaacccgaaacacgaccgcgcggctttagtgccgaaggcgatcgaggcgaacgtgtggcaagcgatcgatgacacaatgcgacaatctccaatcatcagagcacgagtagcagcaggcaagttaaaagtggtgggcgctatctaccatatcgacgacggcaaagtagaatggctgggcgaacatccaatgcaggctcgattactgcagtacacatctggacctgctaaatgccaccgctaa

SEQ ID NO: 1172 - protein, 223 aa, Artificial Sequence
  Engineered variant of carbonic anhydrase from D. vulgaris
MGSMGPGIGPDEALRRLKEGNARFVAETPRRKNLAAKRLATSQHGQTPYATILSCSDSRAPVELIFDEGIGDLFVIRVAGNVAQTDEVGTAEYGVDHLNVPLLVVMGHTQCGAVTAVVQGAEVHGSIPMLLAPIVPAVQAVEKSNPKHDRAALVPKAIEANVWQAIDDTMRQSPIIRARVAAGKLKVVGAIYHIDDGKVEWLGEHPMQARLLQYTSGPAKCHR

SEQ ID NO: 1173 - DNA, 672 bp, Artificial Sequence
  Engineered variant of carbonic anhydrase from D. vulgaris
atgggcagcaccggcccgggcattggcccggacgaagccttacagagattgaaagaggggaatgcgcgcttcgtggccgagactccaagacctcagaacctttctcttcggcggcttctgacctctatgcatggacaaaccccttatgctacaattctgagttgctcggatagtcgtgctccggtggagttaatattcgatgcaggcataggcgaccttttcgtgattagagtggcagggaacgtagcgcagacagatgaggttgggacagcagaatatggtgtggatcaccttaatgtgccgctgctggtggtaatggggcatactcagtgcggggccgtcacagcggttgttatgcgtgcagaagtccgcgggagcattcctatgctggttgcgcctatagttcctgccgttatggccgttgagaaaagttttccgaaaacagaccgtgccgcgctcgtccctaaagcgatagaggccaacgtgtggcaggctatcgacgacactttccgccaatcgccgataataagggcgagggtcgcagctggaaaacttaaggtcgtaggagcaatttaccatattgacgacgggaaagttgaatggctcggtgaacaccccatgcaagcacgacttcttgaatataccagcggcccgaccaaagcgcatcgttaa

SEQ ID NO: 1174 - protein, 223 aa, Artificial Sequence
  Engineered variant of carbonic anhydrase from D. vulgaris
MGSTGPGIGPDEALQRLKEGNARFVAETPRPQNLSLRRLLTSMHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1175 - DNA, 672 bp, Artificial Sequence
  Engineered variant of carbonic anhydrase from D. vulgaris
atgggcagcaccggcccgggcattggcccggacgaagccttacagagattgaaagaggggaatgcgcgcttcgtggccgagactccaagacctcagaacctttctgctcggcggcttctgacctctatgcatggacaaaccccttatgctacaattctgagttgctcggatagtcgtgctccggtggagttaatattcgatgcaggcataggcgaccttttcgtgattagagtggcagggaacgtagcgcagacagatgaggttgggacagcagaatatggtgtggatcaccttaatgtgccgctgctggtggtaatggggcatactcagtgcggggccgtcacagcggttgttatgcgtgcagaagtccgcgggagcattccttttctggttgcgcctatagttcctgccgttatggccgttgagaaaagttttccgaaaacagaccgtgccgcgctcgtccctaaagcgatagaggccaacgtgtggcaggctatcgacgacactttccgccaatcgccgataataagggcgagggtcgcagctggaaaacttaaggtcgtaggagcaatttaccatattgacgacgggaaagttgaatggctcggtgaacaccccatgcaagcacgacttcttgaatataccagcggcccgaccaaagcgcatcgttaa

SEQ ID NO: 1176 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPFLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1177 - DNA, 675 bp, Artificial Sequence
  Engineered variant of carbonic anhydrase from D. vulgaris
atgggcagcaccggcccgggcattggcccggacgaagccttacagagattgaaagaggggaatgcgcgcttcgtggccgagactccaagacctcagaacctttctgctcggcggcttctgacctctatgcatggacaaaccccttatgctacaattctgagttgctcggatagtcgtgctccggtggagttaatatatgatgcaggcataggcgaccttttcgtgattagagtggcagggaacgtagcgcagacagatgaggttgggacagcagaatatggtgtggatcaccttaatgtgccgctgctggtggtaatggggcatactcagtgcggggccgtcacagcggttgttatgcgtgcagaagtccgcgggagcattcctatgctggttgcgcctatagttcctgccgttatggccgttgagaaaagttttccgaaaacagaccgtgccgcgctcgtccctaaagcgatagaggccaacgtgtggcaggctatcgacgacactttccgccaatcgccgataataagggcgagggtcgcagctggaaaacttaaggtcgtaggagcaatttaccatattgacgacgggaaagttgaatggctcggtgaacaccccatgcaagcacgacttcttgaatataccagcggcccgaccaaagcgcatcgttaatga

SEQ ID NO: 1178 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIYDAGIGDLFVIRVAGNVAQTDEVGTAEYGVDHLNVPLLVVMGHTQCGAVTAVVMRAEVRGSIPMLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1179 - DNA, 672 bp, Artificial Sequence
  Engineered variant of carbonic anhydrase from D. vulgaris
atgggcagcaccggcccgggcattggcccggacgaagccttacagagattgaaagaggggaatgcgcgcttcgtggccgagactccaagacctcagaacctttctgctcggcggcttctgacctctatgcatggacaaaccccttatgctacaattctgagttgctcggatagtcgtgctccggtggagttaatattcgatgcaggcataggcgaccttttcgtgattagagtggcagggaacgtagcgcagacagatgaggttgggacagcagaatatggtgtggatcaccttaatgtgccgctgctggtggtaatggggcatactcagtgcggggccgtcacagcggttgttatgcgtgcagaaaaacgcgggagcattcctatgctggttgcgcctatagttcctgccgttatggccgttgagaaaagttttccgaaaacagaccgtgccgcgctcgtccctaaagcgatagaggccaacgtgtggcaggctatcgacgacactttccgccaatcgccgataataagggcgagggtcgcagctggaaaacttaaggtcgtaggagcaatttaccatattgacgacgggaaagttgaatggctcggtgaacaccccatgcaagcacgacttcttgaatataccagcggcccgaccaaagcgcatcgttaa

SEQ ID NO: 1180 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEKRGSIPMLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1181 - DNA, 672 bp, Artificial Sequence
  Engineered variant of carbonic anhydrase from D. vulgaris
atgggcagcaccggcccgggcattggcccggacgaagccttacagagattgaaagaggggaatgcgcgcttcgtggccgagactccaagacctcagaacctttctgctcggcggcttctgacctctatgcatggacaaaccccttatgctacaattctgagttgctcggatagtcgtgctccggtggagttaatattcgatgcaggcataggcgaccttttcgtgattagagtggcagggaacgtagcgcagacagatgaggttgggacagcagaatatggtgtggatcaccttaatgtgccgctgctggtggtaatggggcatactcagtgcggggccgtcacagcggttgttatgcgtgcagaagtccgcgggagcattcctatgctggttgcgcctatagttcctgccgttatggccgttgagaaaagttttccgaaaaaagaccgtgccgcgctcgtccctaaagcgatagaggccaacgtgtggcaggctatcgacgacactttccgccaatcgccgataataagggcgagggtcgcagctggaaaacttaaggtcgtaggagcaatttaccatattgacgacgggaaagttgaatggctcggtgaacaccccatgcaagcacgacttcttgaatataccagcggcccgaccaaagcgcatcgttaa

SEQ ID NO: 1182 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKSFPKKDRAALVPKAIEANVWQAIDDTFRQSPIIRARVAAGKLKVVGAIYHIDDGKVEWLGEHPMQARLLEYTSGPTKAHR

SEQ ID NO: 1183 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgtatttagtggcgccgattgtgcctgcagtaatggctgtagagaagcgttttccgaaaattgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1184 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPYLVAPIVPAVMAVEKRFPKIDRAALVPKAIEANVWQAIDDTFRQSPIIRARVAAGKLKVVGAIYHIDDGKVEWLGEHPMQARLLEYTSGPTKAHR

SEQ ID NO: 1185 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1186 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1187 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggaggtacgtggatcaatcccgtatttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1188 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVLRAEVRGSIPYLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1189 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgtttttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1190 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPFLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1191 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgtatttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1192 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPYLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1193 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagcgttttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1194 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVMRAEVRGSIPMLVAPIVPAVMAVEKRFPKTDRAALVPKAIEANVWQAIDDTFRQSPIIRARVAAGKLKVVGAIYHIDDGKVEWLGEHPMQARLLEYTSGPTKAHR

SEQ ID NO: 1195 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgtatttagtggcgccgattgtgcctgcagtaatggctgtagagaagcgttttccgaaaaaagaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1196 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPYLVAPIVPAVMAVEKRFPKKDRAALVPKAIEANVWQAIDDTFRQSPIIRARVAAGKLKVVGAIYHIDDGKVEWLGEHPMQARLLEYTSGPTKAHR

SEQ ID NO: 1197 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctctgcgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagagctgcccgaaaaaagaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1198 - protein, 223 aa, Artificial Sequence
  Engineered variant of carbonic anhydrase from D. vulgaris
MGSTGPGIGPDEALQRLKEGNARFVAETPRPQNLSLRRLLTSMHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKSCPKKDRAALVPKAIEANVWQAIDDTFRQSPIIRARVAAGKLKVVGAIYHIDDGKVEWLGEHPMQARLLEYTSGPTKAHR

SEQ ID NO: 1199 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctctgcgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagcgttttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1200 - protein, 223 aa, Artificial Sequence
  Engineered variant of carbonic anhydrase from D. vulgaris
MGSTGPGIGPDEALQRLKEGNARFVAETPRPQNLSLRRLLTSMHGQTPYATILSCSDSRAPVELIFDAGIGDLFVIRVAGNVAQTAEVGTAEYGVDHLNVPLLVVMGHTQCGAVTAVVMRAEVRGSIPMLVAPIVPAVMAVEKRFPKTDRAALVPKAIEANVWQAIDDTFRQSPIIRARVAAGKLKVVGAIYHIDDGKVEWLGEHPMQARLLEYTSGPTKAHR

SEQ ID NO: 1201 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctctgcgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgtatttagtggcgccgattgtgcctgcagtaatggctgtagagaagagctgcccgaaaattgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1202 - protein, 223 aa, Artificial Sequence
  Engineered variant of carbonic anhydrase from D. vulgaris
MGSTGPGIGPDEALQRLKEGNARFVAETPRPQNLSLRRLLTSMHGQTPYATILSCSDSRAPVELIFDAGIGDLFVIRVAGNVAQTDEVGTAEYGVDHLNVPLLVVMGHTQCGAVTAVVMRAEVRGSIPYLVAPIVPAVMAVEKSCPKIDRAALVPKAIEANVWQAIDDTFRQSPIIRARVAAGKLKVVGAIYHIDDGKVEWLGEHPMQARLLEYTSGPTKAHR

SEQ ID NO: 1203 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctctgcgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggagaaacgtggatcaatcccgatgttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1204 - protein, 223 aa, Artificial Sequence
  Engineered variant of carbonic anhydrase from D. vulgaris
MGSTGPGIGPDEALQRLKEGNARFVAETPRPQNLSLRRLLTSMHGQTPYATILSCSDSRAPVELIFDAGIGDLFVIRVAGNVAQTDEVGTAEYGVDHLNVPLLVVMGHTQCGAVTAVVMRAEKRGSIPMLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1205 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggaggtacgtggatcaatcccgtatttagtggcgccgattgtgcctgcagtaatggctgtagagaagagctttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1206 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVMRAEVRGSIPYLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1207 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggaggtacgtggatcaatcccgtatttagtggcgccgattgtgcctgcagtaatggctgtagagaagcgttttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1208 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDAGIGDLFVIRVAGNVAQTDEVGTAEYGVDHLNVPLLVVMGHTQCGAVTAVVLRAEVRGSIPYLVAPIVPAVMAVEKRFPKTDRAALVPKAIEANVWQAIDDTFRQSPIIRARVAAGKLKVVGAIYHIDDGKVEWLGEHPMQARLLEYTSGPTKAHR

SEQ ID NO: 1209 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgtttttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1210 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDAGIGDLFVIRVAGNVAQTDEVGTAEYGVDHLNVPLLVVMGHTQCGAVTAVVMRAEVRGSIPFLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1211 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggaggtacgtggatcaatcccgtatttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1212 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVMRAEVRGSIPYLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1213 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1214 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1215 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgtatttagtggcgccgattgtgcctgcagtaatggctgtagagaagagctttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1216 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPYLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1217 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggaggtacgtggatcaatcccgatgttagtggcgccgattgtgcctgcagtaatggctgtagagaagcgttgcccgaaaattgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1218 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVLRAEVRGSIPMLVAPIVPAVMAVEKRCPKIDRAALVPKAIEANVWQAIDDTFRQSPIIRARVAAGKLKVVGAIYHIDDGKVEWLGEHPMQARLLEYTSGPTKAHR

SEQ ID NO: 1219 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgtatttagtggcgccgattgtgcctgcagtaatggctgtagagaagcgttttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1220 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPYLVAPIVPAVMAVEKRFPKTDRAALVPKAIEANVWQAIDDTFRQSPIIRARVAAGKLKVVGAIYHIDDGKVEWLGEHPMQARLLEYTSGPTKAHR

SEQ ID NO: 1221 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtactgcgtgcggaggtacgtggatcaatcccgatgttagtggcgccgattgtgcctgcagtaatggctgtagagaagcgttttccgaaaattgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1222 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVLRAEVRGSIPMLVAPIVPAVMAVEKRFPKIDRAALVPKAIEANVWQAIDDTFRQSPIIRARVAAGKLKVVGAIYHIDDGKVEWLGEHPMQARLLEYTSGPTKAHR

SEQ ID NO: 1223 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1224 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVMRAEVRGSIPMLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1225 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggaggtacgtggatcaatcccgtttttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1226 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVLRAEVRGSIPFLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1227 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggaggtacgtggatcaatcccgtatttagtggcgccgattgtgcctgcagtaatggctgtagagaagagctttccgaaaaaagaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1228 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVMRAEVRGSIPYLVAPIVPAVMAVEKSFPKKDRAALVPKAIEANVWQAIDDTFRQSPIIRARVAAGKLKVVGAIYHIDDGKVEWLGEHPMQARLLEYTSGPTKAHR

SEQ ID NO: 1229 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagagctttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1230 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVMRAEVRGSIPMLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1231 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtactgcgtgcggaggtacgtggatcaatcccgtttttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1232 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVLRAEVRGSIPFLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1233 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggaggtacgtggatcaatcccgtttttagtggcgccgattgtgcctgcagtaatggctgtagagaagagctttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1234 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVMRAEVRGSIPFLVAPIVPAVMAVEKSFPKTDRAALVPKAIEANVWQAIDDTFRQSPIIRARVAAGKLKVVGAIYHIDDGKVEWLGEHPMQARLLEYTSGPTKAHR

SEQ ID NO: 1235 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggaggtacgtggatcaatcccgtatttagtggcgccgattgtgcctgcagtaatggctgtagagaagcgttttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1236 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDAGIGDLFVIRVAGNVAQTAEVGTAEYGVDHLNVPLLVVMGHTQCGAVTAVVMRAEVRGSIPYLVAPIVPAVMAVEKRFPKTDRAALVPKAIEANVWQAIDDTFRQSPIIRARVAAGKLKVVGAIYHIDDGKVEWLGEHPMQARLLEYTSGPTKAHR

SEQ ID NO: 1237 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggaggtacgtggatcaatcccgatgttagtggcgccgattgtgcctgcagtaatggctgtagagaagcgttttccgaaaattgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1238 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVLRAEVRGSIPMLVAPIVPAVMAVEKRFPKIDRAALVPKAIEANVWQAIDDTFRQSPIIRARVAAGKLKVVGAIYHIDDGKVEWLGEHPMQARLLEYTSGPTKAHR

SEQ ID NO: 1239 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctctgcgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagcgttttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1240 - protein, 223 aa, Artificial Sequence
  Engineered variant of carbonic anhydrase from D. vulgaris
MGSTGPGIGPDEALQRLKEGNARFVAETPRPQNLSLRRLLTSMHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKRFPKTDRAALVPKAIEANVWQAIDDTFRQSPIIRARVAAGKLKVVGAIYHIDDGKVEWLGEHPMQARLLEYTSGPTKAHR

SEQ ID NO: 1241 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctctgcgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggaggtacgtggatcaatcccgtatttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1242 - protein, 223 aa, Artificial Sequence
  Engineered variant of carbonic anhydrase from D. vulgaris
MGSTGPGIGPDEALQRLKEGNARFVAETPRPQNLSLRRLLTSMHGQTPYATILSCSDSRAPVELIFDAGIGDLFVIRVAGNVAQTDEVGTAEYGVDHLNVPLLVVMGHTQCGAVTAVVLRAEVRGSIPYLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1243 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtactgcgtgcggaggtacgtggatcaatcccgtatttagtggcgccgattgtgcctgcagtaatggctgtagagaagcgttttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1244 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDAGIGDLFVIRVAGNVAQTAEVGTAEYGVDHLNVPLLVVMGHTQCGAVTAVVLRAEVRGSIPYLVAPIVPAVMAVEKRFPKTDRAALVPKAIEANVWQAIDDTFRQSPIIRARVAAGKLKVVGAIYHIDDGKVEWLGEHPMQARLLEYTSGPTKAHR

SEQ ID NO: 1245 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctctgcgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggagaaacgtggatcaatcccgtttttagtggcgccgattgtgcctgcagtaatggctgtagagaagagctgcccgaaaattgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1246 - protein, 223 aa, Artificial Sequence
  Engineered variant of carbonic anhydrase from D. vulgaris
MGSTGPGIGPDEALQRLKEGNARFVAETPRPQNLSLRRLLTSMHGQTPYATILSCSDSRAPVELIFDAGIGDLFVIRVAGNVAQTAEVGTAEYGVDHLNVPLLVVMGHTQCGAVTAVVMRAEKRGSIPFLVAPIVPAVMAVEKSCPKIDRAALVPKAIEANVWQAIDDTFRQSPIIRARVAAGKLKVVGAIYHIDDGKVEWLGEHPMQARLLEYTSGPTKAHR

SEQ ID NO: 1247 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctctgcgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggaggtacgtggatcaatcccgatgttagtggcgccgattgtgcctgcagtaatggctgtagagaagagctgcccgaaaattgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1248 - protein, 223 aa, Artificial Sequence
  Engineered variant of carbonic anhydrase from D. vulgaris
MGSTGPGIGPDEALQRLKEGNARFVAETPRPQNLSLRRLLTSMHGQTPYATILSCSDSRAPVELIFDAGIGDLFVIRVAGNVAQTDEVGTAEYGVDHLNVPLLVVMGHTQCGAVTAVVLRAEVRGSIPMLVAPIVPAVMAVEKSCPKIDRAALVPKAIEANVWQAIDDTFRQSPIIRARVAAGKLKVVGAIYHIDDGKVEWLGEHPMQARLLEYTSGPTKAHR

SEQ ID NO: 1249 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggagaaacgtggatcaatcccgtatttagtggcgccgattgtgcctgcagtaatggctgtagagaagagctttccgaaaaaagaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1250 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDAGIGDLFVIRVAGNVAQTDEVGTAEYGVDHLNVPLLVVMGHTQCGAVTAVVMRAEKRGSIPYLVAPIVPAVMAVEKSFPKKDRAALVPKAIEANVWQAIDDTFRQSPIIRARVAAGKLKVVGAIYHIDDGKVEWLGEHPMQARLLEYTSGPTKAHR

SEQ ID NO: 1251 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagcgttttccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1252 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKRFPKTDRAALVPKAIEANVWQAIDDTFRQSPIIRARVAAGKLKVVGAIYHIDDGKVEWLGEHPMQARLLEYTSGPTKAHR

SEQ ID NO: 1253 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtactgcgtgcggaggtacgtggatcaatcccgatgttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1254 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVLRAEVRGSIPMLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1255 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtactgcgtgcggagaaacgtggatcaatcccgatgttagtggcgccgattgtgcctgcagtaatggctgtagagaagcgttttccgaaaattgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1256 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVLRAEKRGSIPMLVAPIVPAVMAVEKRFPKIDRAALVPKAIEANVWQAIDDTFRQSPIIRARVAAGKLKVVGAIYHIDDGKVEWLGEHPMQARLLEYTSGPTKAHR

SEQ ID NO: 1257 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggagaaacgtggatcaatcccgatgttagtggcgccgattgtgcctgcagtaatggctgtagagaagcgttgcccgaaaattgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1258 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVLRAEKRGSIPMLVAPIVPAVMAVEKRCPKIDRAALVPKAIEANVWQAIDDTFRQSPIIRARVAAGKLKVVGAIYHIDDGKVEWLGEHPMQARLLEYTSGPTKAHR

SEQ ID NO: 1259 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggagaaacgtggatcaatcccgtatttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1260 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVMRAEKRGSIPYLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1261 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggagaaacgtggatcaatcccgtttttagtggcgccgattgtgcctgcagtaatggctgtagagaagcgttgcccgaaaattgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1262 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTDEVGTAEYGVDHLNVPLLVVMGHTQCGAVTAVVLRAEKRGSIPFLVAPIVPAVMAVEKRCPKIDRAALVPKAIEANVWQAIDDTFRQSPIIRARVAAGKLKVVGAIYHIDDGKVEWLGEHPMQARLLEYTSGPTKAHR

SEQ ID NO: 1263 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggagaaacgtggatcaatcccgatgttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1264 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDAGIGDLFVIRVAGNVAQTDEVGTAEYGVDHLNVPLLVVMGHTQCGAVTAVVLRAEKRGSIPMLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1265 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggatcaatcccgatgttagtggcgccgattgtgcctgcagtaatggctgtagagaagagctgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1266 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDAGIGDLFVIRVAGNVAQTDEVGTAEYGVDHLNVPLLVVMGHTQCGAVTAVVMRAEVRGSIPMLVAPIVPAVMAVEKSCPKTDRAALVPKAIEANVWQAIDDTFRQSPIIRARVAAGKLKVVGAIYHIDDGKVEWLGEHPMQARLLEYTSGPTKAHR

SEQ ID NO: 1267 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgcatggacaaacgccgtatgccacgatcctttcttgtagtgattcaagagcgccagtagagctgatcttcgacgcgggcattggcgatctattcgttatccgtgttgcgggcaatgtagcgcagacagcggaagtgggaacagcggagtacggagtggaccaccttaacgttcctttgcttgtagtgatgggccatacacaatgcggtgctgtaactgcagtggtaatgcgtgcggagaaacgtggatcaatcccgatgttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1268 - protein, 223 aa, Artificial Sequence
  Engineered variant of carbonic anhydrase from D. vulgaris
MGSTGPGIGPDEALQRLKEGNARFVAETPRPQNLSARRLLTSMHGQTPYATILSCSDSRAPVELIFDAGIGDLFVIRVAGNVAQTAEVGTAEYGVDHLNVPLLVVMGHTQCGAVTAVVMRAEKRGSIPMLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1269 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtactgcgtgcggagaaacgtggatcaatcccgtttttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1270 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDAGIGDLFVIRVAGNVAQTDEVGTAEYGVDHLNVPLLVVMGHTQCGAVTAVVLRAEKRGSIPFLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1271 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtttgccacggtgctttcttgtagtgattcaagagcgccagtagagctgatcttcgaccagggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggaaacatcccgtttttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1272 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPFATVLSCSDSRAPVELIFDQGIGDLFVIRVAGNVAQTDEVGTAEYGVDHLNVPLLVVMGHTQCGAVTAVVMRAEVRGNIPFLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1273 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaacaccttaacgttcctttgcttgtagtgatgggccatacacaatgcggtgctgtaactgcagtggtaatgcgtgcggaggtacgtggatcaatcccgtttttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacaccggcaaagtagaatggctgggcgaacatccaatgcaggctcgattactggaatacacatctggacctaccaaagctcaccgctaa

SEQ ID NO: 1274 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDAGIGDLFVIRVAGNVAQTDEVGTAEYGVEHLNVPLLVVMGHTQCGAVTAVVMRAEVRGSIPFLVAPIVPAVMAVEKRCPKTDRAALVPKAIEANVWQAIDDTFRQSPIIRARVAAGKLKVVGAIYHIDTGKVEWLGEHPMQARLLEYTSGPTKAHR

SEQ ID NO: 1275 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgaccagggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggaaacatcccgtttttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1276 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDQGIGDLFVIRVAGNVAQTDEVGTAEYGVDHLNVPLLVVMGHTQCGAVTAVVMRAEVRGNIPFLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1277 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtttgccacggtgctttcttgtagtgattcaagagcgccagtagagctgatcttcgaccagggcattggcgatctattcgttgtgcgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggaaacatcccgtttttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1278 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPFATVLSCSDSRAPVELIFDQGIGDLFVVRVAGNVAQTDEVGTAEYGVDHLNVPLLVVMGHTQCGAVTAVVMRAEVRGNIPFLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1279 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacggtgctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggaaacatcccgtttttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1280 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATVLSCSDSRAPVELIFDAGIGDLFVIRVAGNVAQTDEVGTAEYGVDHLNVPLLVVMGHTQCGAVTAVVMRAEVRGNIPFLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1281 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtatgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaacaccttaacgttcctttgcttgtagtgatgggccatacacaatgcggtgctgtaactgcagtggtaatgcgtgcggaggtacgtggatcaatcccgtttttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1282 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPYATILSCSDSRAPVELIFDAGIGDLFVIRVAGNVAQTDEVGTAEYGVEHLNVPLLVVMGHTQCGAVTAVVMRAEVRGSIPFLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1283 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtttgccacgatcctttcttgtagtgattcaagagcgccagtagagctgatcttcgaccagggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggaaacatcccgtttttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1284 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPFATILSCSDSRAPVELIFDQGIGDLFVIRVAGNVAQTDEVGTAEYGVDHLNVPLLVVMGHTQCGAVTAVVMRAEVRGNIPFLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1285 - DNA, 672 bp, Artificial Sequence
  Engineered variant of carbonic anhydrase from D. vulgaris
atgggtagcacgggaccgggaattggaccagacgaagctttacagcgtcttaaggaaggaaatgctagatttgtagccgaaacacctcgtccgcagaacttatctgcacgtcgcctgctgacgtctatgctgggacaaacgccgtttgccacgatcctttcttgtagtgattcaagagcgccagtagagctgatcttcgacgcgggcattggcgatctattcgttatccgtgttgcgggcaatgtagcgcagacagatgaagtgggaacagcggagtacggagtggaccaccttaacgttcctttgcttgtagtgatgggccatacacaatgcggtgctgtaactgcagtggtaatgcgtgcggaggtacgtggaaacatcccgtttttagtggcgccgattgtgcctgcagtaatggctgtagagaagcgttgcccgaaaaccgaccgcgcggctttagtgccgaaggcgatcgaggcgaacgtgtggcaagcgatcgatgacacatttcgacaatctccaatcatcagagcacgagtagcagcaggcaagttaaaagtggtgggcgctatctaccatatcgacgacggcaaagtagaatggctgggcgaacatccaatgcaggctcgattactggaatacacatctggacctaccaaagctcaccgctaa

SEQ ID NO: 1286 - protein, 223 aa, Artificial Sequence
  Engineered variant of carbonic anhydrase from D. vulgaris
MGSTGPGIGPDEALQRLKEGNARFVAETPRPQNLSARRLLTSMLGQTPFATILSCSDSRAPVELIFDAGIGDLFVIRVAGNVAQTDEVGTAEYGVDHLNVPLLVVMGHTQCGAVTAVVMRAEVRGNIPFLVAPIVPAVMAVEKRCPKTDRAALVPKAIEANVWQAIDDTFRQSPIIRARVAAGKLKVVGAIYHIDDGKVEWLGEHPMQARLLEYTSGPTKAHR

SEQ ID NO: 1287 - DNA, 714 bp, Desulfovibrio sp. FW1012B
atgaaacggtttcttgcggccacggccaccatggcgtttttgctggcgatgtgcacagcggtcctggcctcttccggcggttcggaagtgagcgccgacgaggccctgtcccggctcaaggaaggcaacacgcggttcgtgtcccaggccaacgtcgcgccgcatcaggacgccgcccgtcggcatgaaaccgccaccggcggacagcacccgtttgccacggtcctgtcctgcgccgattcccgggccccggtcgaggtcctcttcgaccagggcgtgggcgaccttttcgtggtccgcgtggccggcaacgtggccgccaccgacgagatcggcaccatcgagtacggggccgagcacctcggcgtgccgttggtggtggttctggcccacaccaaatgcggggcggtcacggcggtggtcaaaaacgagcccgtcaccgagaacatcggcaagctggtggcccccatcgtgccggcggtcaagggcatcaaggcccgtttcgccgcttcggacgtcaacgagatcatcagccggtccatcgaggccaacatgtggcaggccatcagcgacatctacgccaaaagcccgatgctcaaaaagatggcggccgacggcaagatcaaggtcgtgggcgccctctacgacatcgactccggcgaagtgcgctggttcggcgagcacccgtccgaaggctccctgctcgacaattaa

SEQ ID NO: 1288 - protein, 237 aa, Desulfovibrio sp. FW1012B
MKRFLAATATMAFLLAMCTAVLASSGGSEVSADEALSRLKEGNTRFVSQANVAPHQDAARRHETATGGQHPFATVLSCADSRAPVEVLFDQGVGDLFVVRVAGNVAATDEIGTIEYGAEHLGVPLVVVLAHTKCGAVTAVVKNEPVTENIGKLVAPIVPAVKGIKARFAASDVNEIISRSIEANMWQAISDIYAKSPMLKKMAADGKIKVVGALYDIDSGEVRWFGEHPSEGSLLDN

SEQ ID NO: 1289 - DNA, 978 bp, Desulfomicrobium baculatum (strain DSM 4028)
atgttcatcaaacgtcttgtcctggtctttctgcttgtctttgctccgctttcggtcatggcgtcatctcctggcgctcatcccgtaagtcccgaaaatggattgaagatgctcaccgaaggaaacctgcggttcgccctgggccaatcgacccaccccaacaccagtttttccaggcgtctgctaaccaccacggaaggacaggcccccttcgctacggtcatcgcctgctccgattcgagagtcccggttgaaatccttttcgatcaagggattggagacttgtttgtgatcaaggtcgccggcaacgtggccgacacggacgaaatcgggtccgccgaatatggcgtggaccatctcggcacgccggtgctcatggtgctcggacactcctactgcggcgccgtcacggccgtgaccacgggggccgaggtccatggcagcattcccgccctggtcgacaacatcgtgcctgcggtggataaggctcgccatgatcacccggatgccgaaactcccgaactcatcgtccaggccatcgagaccaatgtctggcaggccatcgaagacctgctcgacaccagccacgctatcgccgaccgggccaaggacggccgggttatcgtgattggagccgtgtacgacatcctcaccggcaaggtgaacattctgggcgctcatcccaaccagaccgagctcctgggcggagtgacgcccccggtccacgccgaacccgccatgcacgcagaaccggcaaaggatgcccacgctccggccgagcaggcgccagccgaacaggcggacgccgcccatgcggacccgaccgtggaaaaggccgcggccgaagggcatgccgaagcggcggaagccccttcctccggagggttcggctttttctccttcatcgtgttcgttcttctgctcattggagcggtcttcgtgctcgacaagaagatactcaatcccgaccaggactaa

SEQ ID NO: 1290 - protein, 325 aa, Desulfomicrobium baculatum (strain DSM 4028)
MFIKRLVLVFLLVFAPLSVMASSPGAHPVSPENGLKMLTEGNLRFALGQSTHPNTSFSRRLLTTTEGQAPFATVIACSDSRVPVEILFDQGIGDLFVIKVAGNVADTDEIGSAEYGVDHLGTPVLMVLGHSYCGAVTAVTTGAEVHGSIPALVDNIVPAVDKARHDHPDAETPELIVQAIETNVWQAIEDLLDTSHAIADRAKDGRVIVIGAVYDILTGKVNILGAHPNQTELLGGVTPPVHAEPAMHAEPAKDAHAPAEQAPAEQADAAHADPTVEKAAAEGHAEAAEAPSSGGFGFFSFIVFVLLLIGAVFVLDKKILNPDQD

SEQ ID NO: 1291 - DNA, 786 bp, Desulfovibrio aespoeensis
atggaccgtaaattccattccctggccatcatctgcgcgaacgttgtgtttgccactgtcctggtggccttggcccaggccgagctggtggtgggcaaagcctcacccgacgaggtcatggccatgctcaaggaaggcaacgagcggttcgtcgccgggaaggcgctccatgaaaacaccgacgcggagcggctggcccaggccgggaacgagagccaggccgatcatgcctttgccaccgtgctttcctgcgcggattcccgcgtgccggtggagcggattttcgacgccggattcatagacctgttcgtggtccgggtggcgggcaatgtggtgaaaaccgacgaggccgggtccatcgagtacgggctggcccatgtgcacacgccggtgctggtggtcatggggcacacccaatgcggcgctgtcgcagccgtgaccgacgtggtgcaggggcgcaagctgacgtttgaacgcaatattccgccgctggtcgctcccatcatcccggctgtgcagcgggccatcgccgcccatcccgatgcttcgggcagggccgtgttgccctttgccatcgaggagaacgtctggcagggcatcacggacctgttcatgcagagcccggccacccgcatgatcgtcaggtccggcaaggtcaaggtggtcggggcgatttacgacgtcgggactggccgcgtcagttggctgcccgagtccagggttctcgaactgctggacgcggtggagcgcgaccctggccgtgccatgaacgccatggccgagtag

SEQ ID NO: 1292 - protein, 261 aa, Desulfovibrio aespoeensis
MDRKFHSLAIICANVVFATVLVALAQAELVVGKASPDEVMAMLKEGNERFVAGKALHENTDAERLAQAGNESQADHAFATVLSCADSRVPVERIFDAGFIDLFVVRVAGNVVKTDEAGSIEYGLAHVHTPVLVVMGHTQCGAVAAVTDVVQGRKLTFERNIPPLVAPIIPAVQRAIAAHPDASGRAVLPFAIEENVWQGITDLFMQSPATRMIVRSGKVKVVGAIYDVGTGRVSWLPESRVLELLDAVERDPGRAMNAMAE

SEQ ID NO: 1293 - DNA, 1200 bp, Desulfovibrio desulfuricans (strain G20)
atgattttcaaatcgcggaaaaccctgctggctgcccttggactggtggctttgtttcttgttttcggtgcgttttcgtgcagcagtgacagcacggtggaacgtacgcccgaagctgcgctgaaagccctcagacagggcaacgaacgttttgcagccggcgaagctgtgcacccccggactgatgccgcgcgtctggcgcaggccggcacggaaagtcagggcgatcatgcatacgccacagtgctggcctgttctgactcacgcgtgcccgtggaacgcctgtttgatgccggagtcatggatatttttgtggtgcgtgtggccggcaacgtagtgcagggcgacgaagccggttccattgaatatggtctggcccatgtgaaaacccctgtgctggtggtgctgggacatacccagtgcggtgccgtgaccgccgtgaccgcagcgctggaaggacacggtcatgcgctggaacgcaatatccccggtctggtcaagcccgtcattcctgccgtgcagcaggccatgcaggaacaccccgatgtgcacggtgcggatctggtgcccttcggcattgaaaataatgtctggcagaacatccgtaatcttttcatgctgagccccgccaccagagatctggtaaaatccggcaaggtggctgttgtcggagccgtatacgatgtgtccaccggcaaggttgaatggctgcccgccgcccgcgtggatgaaattcttgccgcagtggaagcagaccccgcccgtgcgacggaagccatggcttccggggccggcgccgcacagccggaccatgacggcgcgcccgctgctgcagcagaaaatgaacaggccgtatccgaagctgaacacgctgctgatgctgcagaagacgccgccggatcttccggttccggcgcagaggttgaaaccgttgaagccgttgaggttcccgcggccaacgccacagacgcaggcgaagagaccgtgacgcaggaagccgcagtgccctgccccggtcagatggcccgcgacaccatggccattcatgcacaggctgcgctggaacaggctgaaatggcgggcaaggccgcacaggttgccgccgaagctgccgcaaaggctgccgaggccgcgggagaagccgcccgtgccgccgaagccgctgcactggcggcgcaggccgctcaggcgcagcagtag

SEQ ID NO: 1294 - protein, 399 aa, Desulfovibrio desulfuricans (strain G20)
MIFKSRKTLLAALGLVALFLVFGAFSCSSDSTVERTPEAALKALRQGNERFAAGEAVHPRTDAARLAQAGTESQGDHAYATVLACSDSRVPVERLFDAGVMDIFVVRVAGNVVQGDEAGSIEYGLAHVKTPVLVVLGHTQCGAVTAVTAALEGHGHALERNIPGLVKPVIPAVQQAMQEHPDVHGADLVPFGIENNVWQNIRNLFMLSPATRDLVKSGKVAVVGAVYDVSTGKVEWLPAARVDEILAAVEADPARATEAMASGAGAAQPDHDGAPAAAAENEQAVSEAEHAADAAEDAAGSSGSGAEVETVEAVEVPAANATDAGEETVTQEAAVPCPGQMARDTMAIHAQAALEQAEMAGKAAQVAAEAAAKAAEAAGEAARAAEAAALAAQAAQAQQ

SEQ ID NO: 1295 - DNA, 714 bp, Desulfovibrio magneticus (strain ATCC 700980)
atgaaacggttcgttgcggcgtttgcgggagcggtcatcacgttttccatggctggggcggccatggcgttttccggcggggcgggcatttccgccgatgaggcgctggcccgcctcaaggaaggcaacacccgctatgtggccggcgcggccgtgaccccgcgtcaggacgcggcccggcggcatgaaaccgccaccggcggccagcatccctttgtctcggtgctgtcctgcgccgattcccgcgtgcccgtggaaaccgtgttcgaccagggcattggcgatgtgttcgtgatccgcgtggccggcaacgtggccaacaccgacgagatcggtaccatcgaatacgggaccgaacacctgggcacccccctggtggtggtcctggcccacaccaaatgcggcgcggtcacggccgtggtcaagggcgagcatgtcaccgaaaacatcggcaagctcgtggcccccatcgtgccggccgtggcttcggtgaaaagccgctttgcctcgggcgacttgaacgagcttatcaaccgctccatcgaggccaacatgtggcaggccatcgccgacatgtacgccaaaagccccttgctcaagaagatggcggccgacggcaagatcaaggttgtgggcgcgctctatgacatcgattccggcgatgtccattggtttggcgagcatccgtccaacgccaaccttatcggcaagtag

SEQ ID NO: 1296 - protein, 237 aa, Desulfovibrio magneticus (strain ATCC 700980)
MKRFVAAFAGAVITFSMAGAAMAFSGGAGISADEALARLKEGNTRYVAGAAVTPRQDAARRHETATGGQHPFVSVLSCADSRVPVETVFDQGIGDVFVIRVAGNVANTDEIGTIEYGTEHLGTPLVVVLAHTKCGAVTAVVKGEHVTENIGKLVAPIVPAVASVKSRFASGDLNELINRSIEANMWQAIADMYAKSPLLKKMAADGKIKVVGALYDIDSGDVHWFGEHPSNANLIGK

SEQ ID NO: 1297 - DNA, 1666 bp, Homo sapiens
cctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccttggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattct

SEQ ID NO: 1298 - protein, 260 aa, Homo sapiens
MSHHWGYGKHNGPEHWHKDFPIAKGERQSPVDIDTHTAKYDPSLKPLSVSYDQATSLRILNNGHAFNVEFDDSQDKAVLKGGPLDGTYRLIQFHFHWGSLDGQGSEHTVDKKKYAAELHLVHWNTKYGDFGKAVQQPDGLAVLGIFLKVGSAKPGLQKVVDVLDSIKTKGKSADFTNFDPRGLLPESLDYWTYPGSLTTPPLLECVTWIVLKEPISVSSEQVLKFRKLNFNGEGEPEELMVDNWRPAQPLKNRQIKASFK

SEQ ID NO: 1299 - DNA, 1459 bp, Rattus norvegicus
gcgtgactatgtcccaccactggggatacagcaagagcaacggaccagagaactggcacaaggagttccccattgccaatggagaccgacagtcccctgtggacattgacaccgggactgcccagcatgacccttccctacagcctctgctcatatgttacgataaggttgcttccaagagcattgtcaacaatggccattccttcaacgttgagtttgatgactcccaggactttgcagtgctgaaagagggacccctcagtggctcctacagattgatccagtttcactttcactggggctcatctgatggccagggctctgagcacaccgtgaacaaaaaaaaatatgctgcagagcttcacttggttcactggaacaccaaatatggggattttggaaaagctgtgcagcacccagatggactggctgttttgggtatttttttgaagattggacctgcctcacaaggccttcagaaaatcactgaagcactgcattccattaaaacaaaggggaaacgtgcagcctttgctaactttgatccttgctcccttcttcctggaaacttggactactggacatatcctggctctctgaccactccgcccctgctggaatgtgtgacctggatagtgctcaaggaacccattactgtcagcagtgagcagatgtctcatttccgtaaactgaacttcaattcggagggggaggctgaagaactgatggtggacaactggcgtccagctcagccgctgaagaacagaaagatcaaggcgtcctttaaataaaatgaccctgcagctggggtccaaaaagcacaagtgtggctgcctctctgtagctaagcacagttccgccttggtgattcagatcccgactttgcatctgatattgtaggcctttttacctctcacccattgtgcttactaataaaatgtgaaaaggaagacccaggtgtctcatgtggtggtagcatggtggcaggctggtggttgacttagggcatcctttctcagccacaacaatgcaatgcaaagaacagatatggcctcttgcttctccacagccatagaataatgagtactcaggcctgtttattaaaatgctatttttaaaaccatataaggtagaatgattgtttacaaatccacatcatgagacaaactgaggcaatttaggcaaatcaggtaaaacagtcatagttttatggttattaattagatgaatgttcactattccaagatcttatattaaagaaaaacttttaaaaagcttatatatttgtagcaaagttattcttaaatatgaattatgttgtaacttagtgacttttgatttctagaggtgtaaatgaagatgtaaaaattgatatagttgtgatacagagtatatttcccttcagataacttaccataacctaatggataatgtattttagatatattctctaataaaa

SEQ ID NO: 1300 - protein, 260 aa, Rattus norvegicus
MSHHWGYSKSNGPENWHKEFPIANGDRQSPVDIDTGTAQHDPSLQPLLICYDKVASKSIVNNGHSFNVEFDDSQDFAVLKEGPLSGSYRLIQFHFHWGSSDGQGSEHTVNKKKYAAELHLVHWNTKYGDFGKAVQHPDGLAVLGIFLKIGPASQGLQKITEALHSIKTKGKRAAFANFDPCSLLPGNLDYWTYPGSLTTPPLLECVTWIVLKEPITVSSEQMSHFRKLNFNSEGEAEELMVDNWRPAQPLKNRKIKASFK

SEQ ID NO: 1301 - DNA, 1481 bp, Bos taurus
acacacggcgcgggcacctgagcagcagcccccggaccccggcgcgaccatgtcccatcactggggatacggcaagcacaacggccccgaacactggcataaggactttcccattgccaacggagagcgccagtcacccgttgacatcgacaccaaggccgtcgttcaggatcctgctttgaagcctctggcccttgtctatggggaagcaacttcgcggagaatggtcaacaatggtcactcttttaacgtggagtatgacgactcccaggacaaagcagtgctgaaagatggacctcttactggcacttacagattggttcagtttcactttcactggggctcatctgatgaccaaggttctgagcatactgtggataggaagaaatatgctgccgagctacacctggttcactggaacaccaagtacggggactttggaacagcagcacagcagcctgatggactggctgttgtgggtgtttttttgaaggttggtgatgctaacccagccctccagaaagtccttgacgcgctggattctattaaaacaaagggtaagagcaccgacttccccaacttcgatccgggcagcctccttcctaacgtcttggactactggacctaccctggctcactgaccacccctcctctcctcgaaagcgtgacctggatcgtgctcaaagaacccatctctgttagcagtcagcagatgttgaaattccgtactcttaacttcaacgcggagggcgagcctgaactcctgatgttggccaactggcgtccggctcagccgctgaaaaacagacaagtcagaggtttccccaaataagaaggccccggggcggtgtccaggggacagcctttgggcctccctttagcttagcacaagtccacttggtgaactggcccctcgctgctttgcgtttggccttctagacccttcgtctctcacctgacgtacttactactaaaatgtgaaaacctagaccaattgtcatgattgacagatttgctgtgactggtgctttgcttatgatggtagcctttctgtgacagagaatataagaaccttgattttgctcacagaatgtggggtaatgagcactcacaatggttcagtaaaatgctatttttaaaatataggaaggtaggatgattgagtgcaaatctatatacgagggtagattgaactatgtgatataaatcaggtaaaatagtctcgatcctatgtaatgtaaatcagataaatgtttgtgattccaagatggtataataaaaactttaaattcttatatatttgtagcaatggtatcttaattatgctatgatttagtgacttttgaactatagcaatgtaaatgaattatctataaaaattgttatagttgtaatacagagtatatttccattcaaataatatatcataacttaataaatattgtattttagatacattctctaataaaatctggaattct

SEQ ID NO: 1302 - protein, 260 aa, Bos taurus
MSHHWGYGKHNGPEHWHKDFPIANGERQSPVDIDTKAVVQDPALKPLALVYGEATSRRMVNNGHSFNVEYDDSQDKAVLKDGPLTGTYRLVQFHFHWGSSDDQGSEHTVDRKKYAAELHLVHWNTKYGDFGTAAQQPDGLAVVGVFLKVGDANPALQKVLDALDSIKTKGKSTDFPNFDPGSLLPNVLDYWTYPGSLTTPPLLESVTWIVLKEPISVSSQQMLKFRTLNFNAEGEPELLMLANWRPAQPLKNRQVRGFPK

SEQ ID NO: 1303 - DNA, 1445 bp, Gallus gallus
cccgacgcggctccgcggcgggaggatcgcgggttataagcggacctctctctctccgcccccgagcgaagtctccctccgcccccgcccgcgctccccaccccttcctccggccgcggagaagggcatggagttcgcgggagcctataaaagcccctgacagcccgccgaggccacggcgttgcgatagccgacggagccgggccggcgcaccatgtcccatcactgggggtacgacagccacaacggacccgcgcactggcacgagcacttccccatcgccaatggggagcgccagtcgcccatcgccatcagcaccaaagccgcccgctacgaccccgcgctgaagcccctcagcttcagctacgatgccggcacggccaaagccatcgtcaacaacgggcactccttcaacgtggagtttgacgactcctccgacaagtcagtgctgcaaggaggagcgctggatggagtctacaggttggtgcagtttcacattcactggggatcctgtgagggccagggctctgagcacactgtggatggcgtgaagtacgatgcagagcttcatattgttcactggaatgtaaaatatggcaaatttgctgaagctctgaagcatcctgatggtttggccgtcgtaggcatcttcatgaaggtagggaatgccaaacctgaaatacagaaagttgttgatgctctgaactccattcaaaccaaggggaaacaagcttctttcacaaactttgaccctactggactgctgcctccatgcagagactattggacgtaccctggctccctgactactccaccactgcatgaatgtgtgatttggcatgttctgaaggagcccatcactgtcagctctgagcagatgtgcaaactccgtggcctttgcttcagtgctgagaatgagccggtgtgccgcatggtggacaactggcgcccatgccagcctctaaagagcagggaagtcagagcttccttccagtaacctcagcgatgagtgtgttagaaactgctgtgtttgcgaggaaccctttttgctaagcacaaatcaaacctttgccatgtgtgccctggcaacatcttgtctcccatattcattctctctttcgctctgcatctaaaatgccagctaatgaaatgtgaaaggctcttggccaaacaggaaggggttcttcatgtgtggagctggggaaaacctgaggggggctgtgtgcattttgatgacttactgcgactgacattttggaaaaaacaaaaacaaacaaaaaaaaactatattggctgtttgggagagcatatggtgagagcaaaataagccattctgagaaacctcatccactggtgtgatagtacacataactaatgataacttgaagctttgtgaaaagcacaggaaaacaaaatataggtatagtataggaaaaaaaaaaaaa

SEQ ID NO: 1304 - protein, 260 aa, Gallus gallus
MSHHWGYDSHNGPAHWHEHFPIANGERQSPIAISTKAARYDPALKPLSFSYDAGTAKAIVNNGHSFNVEFDDSSDKSVLQGGALDGVYRLVQFHIHWGSCEGQGSEHTVDGVKYDAELHIVHWNVKYGKFAEALKHPDGLAVVGIFMKVGNAKPEIQKVVDALNSIQTKGKQASFTNFDPTGLLPPCRDYWTYPGSLTTPPLHECVIWHVLKEPITVSSEQMCKLRGLCFSAENEPVCRMVDNWRPCQPLKSREVRASFQ

SEQ ID NO: 1305 - DNA, 783 bp, Cyprinus carpio
atgtctcacgcttggggttatggaacacaagacgggccagaaacgtgggcagaaagctttcccgttgccaacggacccaggcagtctcccattgatatcgtacccacccaagcacaacatgacccgtctctgaagcacctcaaattgaagtatgaccccgccactgctaagggcatcctcaacaatggccattcattccaagtggatttcactgatgacgacaacagctcaactctggctggaggtcccgtgacggggatatacaggttgagacagttccatttccactggggaagcagtgatgacaagggctcagagcacactgttgctggaaccaagttcccctgtgagcttcatctcgttcactggaacaccaagtacccaaactttggcgaagctgccagtaagcctgatggccttgctgtggttggagtttttctaaagattggttctgccaatccaagacttcagaaagttttagatgctcttgatgacatcagatcaaagggcagacagactacatttagcaactttgatcctaagaccttgctgcccgccgctctggatttctggacttacgaggggtctctgaccacacctcctcttctggagagtgtcacctggatcgttctgaaagacccagtcagtgttagtcctgctcagatggctaagttccgtagcctgctgttcacatctgaaggagaggcaccttcctgcatggttgacaacttcagaccccctcaacctctcaagggacgtaaagtccgtgcatccttcaagtaa

SEQ ID NO: 1306 - protein, 260 aa, Cyprinus carpio
MSHAWGYGTQDGPETWAESFPVANGPRQSPIDIVPTQAQHDPSLKHLKLKYDPATAKGILNNGHSFQVDFTDDDNSSTLAGGPVTGIYRLRQFHFHWGSSDDKGSEHTVAGTKFPCELHLVHWNTKYPNFGEAASKPDGLAVVGVFLKIGSANPRLQKVLDALDDIRSKGRQTTFSNFDPKTLLPAALDFWTYEGSLTTPPLLESVTWIVLKDPVSVSPAQMAKFRSLLFTSEGEAPSCMVDNFRPPQPLKGRKVRASFK

SEQ ID NO: 1307 - DNA, 759 bp, Neisseria gonorrhoeae
atgcctcgtttcccccgcactttaccccgcctgaccgctgtcctgctgttggcctgtaccgctttctccgccgccgcacacggcaatcacacccattggggctataccggacacgactctcccgaaagctggggcaatctgtcagaagaattccgtttgtgctccaccggcaaaaaccaatctccggtaaacattaccgaaaccgtttccggcaaactgcccgccatcaaagtcaattacaaaccgagtatggttgacgtggaaaacaacggccacaccattcaggtcaattatcccgaaggcggcaataccctgaccgtgaacggccgcacctataccctgaaacagttccacttccacgtgccgagcgaaaaccaaatcaaaggccgcactttcccgatggaagctcacttcgtccacttagacgaaaacaaacagcctttagtattagccgtgctgtatgaagccggcaaaaccaacggccgcctgtcttccatctggaacgtcatgccgatgaccgcaggaaaagtgaaactcaaccaaccgttcgacgcatccaccctactgccgaaacggttgaaatactaccgctttgccggttcgctgaccacgccgccgtgcacagagggcgtatcatggttggtgttgaaaacttatgaccacatcgaccaagcgcaagcggaaaaattcacccgcgccgtcggttcggaaaacaaccgccccgtacagcctctgaatgcacgtgtagttattgaataa

SEQ ID NO: 1308 - protein, 252 aa, Neisseria gonorrhoeae
MPRFPRTLPRLTAVLLLACTAFSAAAHGNHTHWGYTGHDSPESWGNLSEEFRLCSTGKNQSPVNITETVSGKLPAIKVNYKPSMVDVENNGHTIQVNYPEGGNTLTVNGRTYTLKQFHFHVPSENQIKGRTFPMEAHFVHLDENKQPLVLAVLYEAGKTNGRLSSIWNVMPMTAGKVKLNQPFDASTLLPKRLKYYRFAGSLTTPPCTEGVSWLVLKTYDHIDQAQAEKFTRAVGSENNRPVQPLNARVVIE

What is claimed is:

1. A method for removing carbon dioxide from a gas stream comprising the step of contacting the gas stream with a homogenous liquid solution under suitable conditions, wherein the solution comprises:
   (i) a β-class carbonic anhydrase polypeptide chemically modified by treatment with a cross-linking agent; and
   (ii) a $CO_2$ absorption mediating compound;
   whereby the solution absorbs carbon dioxide from the gas stream.

2. The method of claim 1, wherein the chemically modified carbonic anhydrase has increased carbonic anhydrase activity in the presence of the $CO_2$ absorption mediating compound relative to the activity of the same carbonic anhydrase polypeptide that is not chemically modified.

3. The method of claim 1, wherein the chemically modified carbonic anhydrase has increased carbonic anhydrase activity in 4.2 M N-methyldiethanolamine (MDEA) at 50° C. compared to the activity under the same conditions of the same carbonic anhydrase polypeptide that is unmodified.

4. The method of claim 1, wherein the cross-linking agent is selected from the group consisting of a dialdehyde, a bis-imidate ester, a bis(N-hydroxysuccinimide) ester, a diacid chloride, and mixtures thereof.

5. The method of claim 1, wherein the cross-linking agent is a dialdehyde having one or more carbon atoms between the two aldehyde groups.

6. The method of claim 1, wherein the cross-linking agent is a dialdehyde selected from the group consisting of glyoxal, succindialdehyde, malondialdehyde, glutaraldehyde, and mixtures thereof.

7. The method of claim 1, wherein the cross-linking agent is a bis-imidate ester having one or more carbon atoms between the two imidate ester groups.

8. The method of claim 7, wherein the bis-imidate ester is selected from the group consisting of malonimidate, succinimidate, glutarimidate, adipimidate, pimelimidate, suberimidate, and mixtures thereof.

9. The method of claim 1, wherein the cross-linking agent is a bis(N-hydroxysuccinimide) ester of a di-carboxylic acid selected from the group consisting of malonate, succinate, glutarate, adipate, pimelate, suberate, and mixtures thereof.

10. The method of claim 1, wherein the β-class carbonic anhydrase polypeptide is a recombinant carbonic anhydrase polypeptide derived from a β-class carbonic anhydrase comprising an amino acid sequence selected from the group consisting of SEQ ID NO: 2, 1288, 1290, 1292, 1294, and 1296.

11. The method of claim 1, wherein the β-class carbonic anhydrase polypeptide is a recombinant carbonic anhydrase polypeptide comprising an amino acid sequence having at least 80% identity to SEQ ID NO: 2.

12. The method of claim 11, wherein the treatment with a cross-linking agent results in a chemically modified lysine residue at one or more residue positions selected from the group consisting of X18, X37, X147, X156, X184, or X198 of SEQ ID NO: 2.

13. The method of claim 1, wherein the $CO_2$ absorption mediating compound is an amine compound selected from the group consisting of: 2-(2-aminoethylamino)ethanol (AEE), 2-amino-2-hydroxymethyl-1,3-propanediol (AHPD), 2-amino-2-methyl-1-propanol (AMP), diethanolamine (DEA), diisopropanolamine (DIPA), N-hydroxyethylpiperazine (HEP), N-methyldiethanolamine (MDEA), monoethanolamine (MEA), N-methylpiperazine (MP), piperazine, piperidine, 2-(2-tert-butylaminoethoxy)ethanol (TBEE), triethanolamine (TEA), triisopropanolamine (TIA), tris, 2-(2-aminoethoxy)ethanol, 2-(2-tert-butylaminopropoxy)ethanol, 2-(2-tert-amylaminoethoxy)ethanol, 2-(2-isopropylaminopropoxy)ethanol, 2-(2-(1-methyl-1-ethylpropylamino)ethoxy)ethanol, and mixtures thereof.

14. The method of claim 1, wherein the $CO_2$ absorption mediating compound is MDEA and the suitable conditions comprise an MDEA concentration of at least 3 M and a solution temperature of from 40° C. to 110° C.

15. The method of claim 1, wherein the $CO_2$ absorption mediating compound is ammonia and the suitable conditions comprise an ammonia concentration of 1 M to 8 M and a solution temperature of from 0° C. to 20° C.

16. The method of claim 1, wherein the $CO_2$ absorption mediating compound is carbonate ion and the suitable conditions comprise from 0.1 M $CO_3^{2-}$ to 5 M $CO_3^{2-}$.

17. The method of claim 1, wherein the method further comprises exposing the homogenous solution comprising the chemically modified carbonic anhydrase polypeptide, the $CO_2$ absorption mediating compound, and absorbed carbon dioxide to suitable conditions for desorbing the carbon dioxide from the solution.

18. A soluble composition having carbonic anhydrase activity comprising a β-class carbonic anhydrase polypeptide chemically modified by treatment with a cross-linking agent.

19. The composition of claim 18, wherein cross-linking agent is selected from the group consisting of a dialdehyde, a bis-imidate ester, a bis(N-hydroxysuccinimide) ester, a diacid chloride, and mixtures thereof.

20. The composition of claim 18, wherein the β-class carbonic anhydrase polypeptide is a recombinant carbonic anhydrase polypeptide having an activity half-life ($t_{1/2}$) of at least 9 hours in 4 M MDEA at 50° C. prior to chemical modification and which comprises an amino acid sequence has at least 80% identity to SEQ ID NO:2.

21. A method for removing carbon dioxide from a gas stream comprising the step of contacting under suitable conditions the gas stream with a solution comprising a soluble composition of claim 18, whereby the solution absorbs carbon dioxide from the gas stream.

22. A homogenous liquid formulation comprising an aqueous solution of the soluble composition of claim 18 and a $CO_2$ absorption mediating compound.

23. A method for removing carbon dioxide from a gas stream comprising the step of contacting the gas stream with a homogenous liquid formulation of claim 22 under suitable conditions, whereby the homogenous liquid formulation absorbs carbon dioxide from the gas stream.

24. A method for preparing a chemically modified β-class carbonic anhydrase comprising contacting in a solution: (i) a β-class carbonic anhydrase polypeptide, wherein the polypeptide comprises an amino acid sequence having at least 80% identity to SEQ ID NO:2; and (ii) a cross-linking agent selected from the group consisting of a dialdehyde, a bis-imidate ester, a bis(N-hydroxysuccinimide) ester, a diacid chloride, and mixtures thereof.

* * * * *